United States Patent 11,111,481 (ATTENUATED VIRUS MUTATED AT SITES OF EVOLUTIONARILY CONSERVED RNA STRUCTURE) - sequence listing, part 5

SEQ ID NO: 1271 - DNA, 10173 bp, Dengue virus
atgaacaaccaacggaaaaagacgggtaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaagacatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaagtgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcggctgaaggagcttggagacaagtcgagaaggtagagacatgggcctttaggcacccagggttcacgatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgcgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcaaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaactgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccctgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaatttttgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaactccgagaaatgtacacccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaattacaggcccggataccacacccaaacggcaggaccatggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctctagtctcagcagggagtggaaaggtggataacttcacaatgggtgtcttgtgtcttgcaatcctctttgaagaggtaatgagaggaaaattcgggaaaaagcacatgattgcaggggttctcttcacatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattggtctccctaatgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctggcaagttctctccttaggaatgacgtacccatggctggaccattagtggctgggggcttgctgatagcgtgctacgtcataactggcacgtcagcagacctcactgtagaaaaagcagcagatgtgacatgggaagaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggagcagtgttgacatacaatggaaaaagactggaaccaagctgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctgggaatgacatagcaaactgcttgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcaggaccaatgccagtcaccgtagcgagtgctgcgcaaaggagagggagagttggcaggaacccacaaaaagaaaatgaccaatacatattcacgggccagcctctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatgtggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggtgatgcttttcttgatatcaggcaaaggggttggaaagacttcaataggactcatttgtgtagttgcttctagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtttcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctatcataggtccaggattgcaggcaaaagccactcgtgaagctcaaaaaaggacggctgctggaataatgaagaatccaacggtggatgggataatgacaatagacctagatcctgtaatatacgactcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatctggaatcactgaagtggatagaacagaagccaaagaagggttgaaaagaggagaaataacacaccatgccgtatccagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacgtatggatggaacatagtcaagctgatgagtggaaaggatgtgttttaccttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacccaccatagagaaagatgtggatttaggagcggggacccgacatgtcaatgcggaaccagaaacacccaacatggacgtcattggggaaagaataagaaggatcaaggaggagcatagttcaacatggcactatgatgatgaaaatccttacaaaacgtgggcttaccatggatcttatgaggtcaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaattcttacagtggagtagaaggggaaggactgcataagctgggatacatcttgagagatatttccaagatacccggaggagctatgtatgctgatgacacagctggatgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagatctcaggatgaattaatagggagagcgagaatctctcagggagcaggatggagccttaaagaaactgcatgcctagggaaagcctacgcccaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 1272 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaggacatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcagctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagccacgtgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatatgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaatgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggttgagtacaaaggggaagacgcaccttgcaagattcccttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaagtagtgacagctgaaatacaaaattcctcctttataatagatgggccaaacacaccagagtgtccaaacgcctcaagagcatggaacgtgtgggaggtggaagattacgggttcggagtcttcacaactaatatatggttgaaactccgagagatgtacacccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaattctctttgaagaggtaatgagaggaaaattcgggaaaaagcacatgattgcagggattctcttcatatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaacgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggtgttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccatgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgcttttcttgatatcaggcaaaggggttggaaagacttcaataggactcatttgtgtagttgcttccagcggcatgttatggatggctgacatcccactccaatggatcgcgtcggccatagttctggagttttttatgatggtgctacttataccagaaccagaaaaacagagaactccccaagacaatcaactcgcatatgtcgtgataggcatacttacattggctgcaatagtagcagccaatgaaatgggattgttggaaaccacaaagagagatttggggatgtccaaagaaccaggagttgttccgccaaccagctatttggatgtggatttgcacccagcatcagcctggacattgtatgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctggtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttgatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatctagaggcagcgcaaaacttcaatggttcgtggagagaaacatggtcattcctgaaggaagggtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcctaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaagactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagttagagggagccatttggtaa

SEQ ID NO: 1273 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaggacatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcagctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagccacgtgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatatgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaatgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggttgagtacaaaggggaagacgcaccttgcaagattcccttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcgtgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaagtagtgacagctgaaatacaaaattcctcctttataatagatgggccaaacacaccagagtgtccaaacgcctcaagagcatggaacgtgtgggaggtggaagattacgggttcggagtcttcacaactaatatatggttgaaactccgagagatgtacacccaactatgtgaccacaggctaatgtcggcagccgttaaggatgagagagccatacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaattctctttgaagaggtaatgagaggaaaattcgggaaaaagcacatgattgcagggattctcttcatgtttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaacgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggtgttggagtacaaaaagaaggagttttccacactatgtggcacgtcacaagaggagcagtgttgacatacaatggaaaaagactggaaccaagctgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccatgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgcttttcttgatatcaggcaaaggggttggaaagacttcaataggactcatttgtgtagttgcttccagcggcatgttatggatggctgacatcccactccaatggatcgcgtcggccatagttctggagttttttatgatggtgctacttataccagaaccagaaaaacagagaactccccaagacaatcaactcgcatatgtcgtgataggcatacttacattggctgcaatagtagcagccaatgaaatgggattgttggaaaccacaaagagagatttggggatgtccaaagaaccaggagttgttccgccaaccagctatttggatgtggatttgcacccagcatcagcctggacattgtatgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctggtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttgatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatctagaggcagcgcaaaacttcaatggttcgtggagagaaacatggtcattcctgaaggaagggtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcctaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaagactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagttagagggagccatttggtaa

SEQ ID NO: 1274 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggagggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttgaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaaagccctgaaaatcaactggtacaggaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggagaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccataaaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgaacacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaagacccaggttatgcacaagggaagagttcacaaaaaaggtcagaactaacgcagccatgggcgccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatactcacagcaatccaacaggtgagaagcctcataggcaatgaagagtttctggactacatgccttcaatgaagagatttaggaaggaggaggagtcggagggagccatttggtaa

SEQ ID NO: 1275 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgataatgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcatcacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacgccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgttaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccgaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggattaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaaccttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacccatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatggggaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1276 - DNA, 10173 bp, Dengue virus; identical to SEQ ID NO: 1269

SEQ ID NO: 1277 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtccttaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatattattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccctgaaaatcaactggtacaagaaggggagctcgattgggaagatgttcgaggccactgccaggggtgcaaggcgcatggccatcttgggagacacagcttgggactttggatcagtgggtggtgttctgaattcattaggcaaaatggtgcaccaaatatttggaagtgcctacacagccctgttcagtggagtctcttgggtgatgaaaattggaataggtgtcctcytgacttggatagggttgaattcaaaaaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagactccccaaaaagattggcaacagctattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggtcctatctcacaacacaactacaggcccgggtaccacacccaaacggcaggaccctggcacttaggaaaattggagctggacttcaactactgtgaaggaacaacagttgtcattacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccattagtgagaaagaagagaatatggtaaagtctttagtctcagcgggaagtggaaaggtggacaacttcacaatgggtgtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacatttaaaatccagccattcttggctttgggattcttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaatatcctaacagtgcttttaaaaacagcattactaatagtatcaggcatttttccatactccatacccgcaacattgttggtctggcacacttggcaaaaacaaacccaaagatccggcgttttatgggacgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactaccacaggggaaataggagcaattgcactggatttcaagcctggaacttcaggatctcctatcataaatagagagggaaaggtagtgggactgtatggcaatggagtggttacaaagaatggtggctatgtcagcggaatagcgcaaacaaatgcagaaccagatggaccgacaccagagttggaagaagagatgttcaaaaagcgaaacttgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggttccaaattacaacttgataataatggatgaggcccattttacagacccagccagtatagcggctagagggtacatatcaactcgtgttggaatgggagaagcagccgcmatcttcatgacagcaacaccccctggaacagctgatgcctttcctcagagcaatgctccaattcaagatgaagaaagggacataccagaacgctcatggaattcaggcaatgaatggattaccgacttcgctgggaaaacggtgtggtttgtccctagcattaaagccggaaatgacatagcaaactgcttgcgaaaaaacgggaaaaaggtcattcaacttagtaggaagacttttgacacagaatatcagaagagtaaactgaatgattgggacttcgtggtgactactgacatttcagaaatgggggccaatttcaaagcagatagagtgatcgacccaagaagatgtctcaaaccagtgatcttgacagatggaccagagcgggtgatcctggccggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagagaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggacaatctggtgatgctgcatacgtcagaacatggcggtagggcttacaggcatgcggtggaggaactaccagaaacaatggaaacactcctactcttgggacttatgattttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagccgccaatgaaatgggactgctggaaaccacaaagagagacttaggaatgtctaaggagccaggtgttgtttctccaaccagctatttggatgtggacttgcacccagcatcagcctggacattgtacgccgtggccacaacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggcccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggctgaaaagaggagagacaacacatcatgctgtgtcccgaggtagcgcaaaactccaatggtttgtggaaagaaacatggtcgttcccgaaggaagagtcatagacttgggctgcggaagaggaggctggtcatattactgtgcaggactgaaaaaagtcacagaagtgcgaggatacacaaaaggcggtccaggacacgaagaaccagtacctatgtctacatatggatggaacatagttaagttaatgagcggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggcaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccctgccagggacaagaaaggttatggggatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagagttttggaaacttgtggacagagaacgtgaactccacaaattgggcaaatgtggaagctgcgtttataacatgatgggcaagagagagaaaaaactcggagagtttggcaaagcaaaaggcagtagagctatatggtacatgtggttgggagtcaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacaggcagttagcgaacgctatattcaagctcacataccaaaacaaagtggtcaaagttcaacgaccgactccaacgggcacggtaatggatattatatctaggaaagaccaaaggggcagtggacaagtgggaacttatggcctgaatacattcaccaacatggaagcccagctagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaacgccctgctagctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctcccaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtccattcatgctcaccatcagtggatgactacagaagacatgcttactgtttggaacagggtgtggatagaggaaaatccatggatggaagacaaaactccagttacaacttgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagtcggagggagccatttggtaa

SEQ ID NO: 1278 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccgacagcgggaatcttggctagatggggaaccttcaagaagtcgggggccattaaggtcctgagaggcttcaagaaggagatctcaaatatgctgagcattatcaacagacggaaaaagacatcgctctgtctcatgatgatattaccagcaacacttgctttccacttgacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgccccctcattactgaagtggagcctgaagacattgactgttggtgcaacctcacatcgacgtgggtgacctatggaacgtgcaaccaagctggagagcacagacgcgataagagatcggtggcgttagctccccatgtcggcatgggactggacacacgcacccaaacctggatgtcggctgaaggagcctggagacaagtcgagaaggtagagacatgggcctttaggcacccagggtttacagtactagccctatttcttgcccatttcataggcacttccttgacccagaaagtggtcattttcatactactaatgctggtcaccccatccatgacaatgagatgtgtgggagtagggaacagagattttgtggaaggcctatcaggagctacgtgggttgacgtggtgcttgaacatggtgggtgtgtaactaccatggctaagaacaagcccacgctggacatagagctccagaagaccgaagccacccaactggcgaccctaaggaaactatgcatcgagggaaaaatcaccaacgtaacaaccgactcaaggtgccccacccaaggagaagcgattttacctgaggaacaggaccagaactacgtgtgtaagcacacatacgtggacagaggctggggaaacggttgtggtttgtttggcaagggaagcttggtaacatgcgcgaaatttcaatgtttggaatcaatagagggaaaagtggtgcagcatgagaacctcaaatacaccgtcatcatcacagtgcatacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaacgcacatgcaaaaaaacaagaagtagtagtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgtttaaatgcctttgtgttgaagaaagaagtctccgaaacacaacatgggacaatactcattaaggttgagtacaaaggggaagatgcaccctgcaagattcctttctccacggaggatggacaagggaaagcccacaatggcagactgatcacagccaacccagtggtgaccaagaaggaggagcctgtcaatattgaggcagaacctccttttggggaaagtaatatagtaattggaattggagacaaagccttgaaaatcaactggtataagaagggaagctcgattgggaaaatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcctggataatgaaaattggaataggtgtccttttaacctggatagggttgaattcaaaaaacacttctatgtcattttcatgcattgtgataggaatcatcacactctatctgggagccgtggtgcaagctgacacggggtgtgttataaactggaaaggcaaggaactcaaatgtggaagtggaattttcgtcactaatgaagtccacacctggacagagcaatacaaatttcaagcagactcccccaaaagactggcgacagccattgcaggtgcctgggagaatggagtgtgcggaatcaggtcgacaactagaatggagaacctcttgtggaagcaaatagccaatgaactgaactacatattatgggaaaacaacatcaaattaacggtagttgtgggtgacataattggggtcttagagcaagggaaaagaacactaacaccacaacccacggagctaaaatattcatggaaaacatggggaaaggcgaaaatagtgacagctgaaacacaaaattcttccttcataatagatgggccaaacacaccagagtgtccaagtgcctcaagagcatggaatgtgtgggaggtggaagaatacgggttcggagtcttcacaactaatatatggctgaaactccgagagatgtacacccaactatgtgaccacaggctaatgtcggcagccgttaaggatgagagagccgtacacgccgacatgggctattggatagaaagccaaaagaatggaagttggaagctagaaaaggcatccctcatagaggtgaaaacctgcacatggccaaaatcacacactctctggagcaacggtgtcctagagagtgacatgatcatcccgaagagtctggctggtcccatttcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacacttcctcccctgcgatacatgggagaagacggctgctggtacggtatggaaattagacccattaatgagaaagaagagaacatggtaaagtctttagtctcagcagggagtggaaaggtggataacttcacaatgggtgtcttgtgtttggcaatcctctttgaagaggtgatgagaggaaaattcggaaaaaagcacatgattgcaggagttctcttcacatttgtgctccttctctcagggcaaataacatggagggacatggcgcgtacactcataatgattgggtccaacgcctctgacagaatgggaatgggcgtcacttacctagcattgattgcaacatttaaaattcagccatttttggccttgggattcttcctgaggaaactgacatctagagaaaatttattgttgggagttgggctggccatggcaacaacgttacaactgccagaggacattgaacaaatggcgaatggaatagctttggggcttatggctctcaaattgataacacaatttgaaacataccaactatggacggcattagtctccctaatgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacccctaccactttttatcttcagtttaaaagatacgctcaaaaggagaagctggccactgaatgagggggtaatggccgtcggacttgtgagcattctagcaagttctctccttaggaatgacgtacccatggctggaccattagtggctgggggcttgctgatagcgtgctacgtcataactggcacgtcagcagacctcactgtagaaaaagcagcaaatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatctttccatactccatacccgcaacactgttggtctggcacacttggcaaaagcaaacccaaagatccggcgttctatgggacgtccccagccccccagagacacagaaagcagaactggaagatggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatctcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactgtatggcaatggagtggtcacaaagaatggtggctatgtcagtggaatagctcaaacaaacgcagagccagatggaccgacaccagagctggaagaagagatgttcaaaaagcgaaatctaaccataatggatctccatcccgggtcaggaaagacgcggaaataccttccagctattgttagagaggcaatcaagagacgcttaaggactctaattttggcaccaacaagggtggttgcagctgagatggaagaagcattgaaagggctcccaataaggtatcaaacgactgcaacaaaatctgaacacacagggaaagagattgttgatctaatgtgtcacgcaacgttcacaatgcgtttgctgtcaccagtcagagttccaaactataacttgataataatggatgaggctcatttcacagatccagccagtatagcggctagagggtacatatcaactcgtgtaggaatgggagaggcagccgcaattttcatgacagccacaccccctggtacagctgatgcctttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaagactaaattaaatgattgggactttgtggtgacaacagacatttcagaaatgggagccaatttcaaagcagacagagtgatcgacccaagaagatgtctcaagccagtcattttgacagacggacctgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaagggatcataccagctctctttgaaccagaaagggagaagtctgccgccatagacggcgaataccgcctgaaaggtgaatctaggaagaccttcgtggaactcatgaggaggggtgacctcccagtctggctagcccataaagtagcgtcagaaggaatcaaatatacagacagaaaatggtgttttgatggagaacgcaacaatcaaattttagaggagaacatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacactcttactcctgggactcatgatcctattaacaggtggggcaatgcttttcttgatatcaggtaaagggattggaaagacttcaataggactcatttgtgtggttgcttccagcggtatgttatggatggctgatgtcccactccaatggatcgcgtcggccatagtcctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttaggaatgtccaaagaaccaggtgttgtctctccaatcagctatttggatgtggatttgcacccagcatcagcctggacattgtatgctgtggccacaacagtaataacaccaatgttgagacataccatagagaattccacagcaaatgtgtccctggcggctatagccaaccaggcagtggtcctgatgggtttagacaaaggatggccgatatcgaaaatggacttaggcgtaccactattagcactgggctgctattcacaagtgaacccactaactctcacagcggcagtactcctgctagtcacgcactacgctattataggtccaggattgcaggcaaaagccactcgtgaagctcaaaaaaggacagctgctggaataatgaagaatccaacggtggatgggataatgacaatagacctagatcctgtaatatacgattcaaaatttgaaaagcaactaggacaggttatgctcctgattttgtgtgcagttcaactcttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagcgaggaacagggtcacaaggtgaaaccttgggagaaaagtggaaaaagaaattgaatcaattatcccggaaagagtttgacctttacaagaaatccggaatcactgaagtggatagaacagaagccaaagaggggttgaaaagaggagaaataacacaccatgccgtgtccagaggcagcgcaaaacttcaatggttcgtggagaggaacatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtactgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagacgtggatttaggagcggggacccgacatgtaaatgcggaaccagaaacacccaacatggatgtcattggggaaagaataagaaggatcaaggaggagcatagttcaacgtggcactatgatgatgaaaatccttataaaacgtgggcttaccatggatcctatgaagttaaggccacaggctcagcctcctctatgataaatggagtcgtgaaactcctcacgaaaccatgggatgtggtgcccacggtgacacagatggcaatgacggacacaacccctttcggccagcaaagggtttttaaagagaaagtggacaccaggacacccagacccatgccaggaacaagaaaggttatggagatcacagcggaatggctttggagaaccctgggaaggaataaaagacccagattatgcacgagagaggagttcacaaaaaaggtcagaaccaacgcagctatgggcgccgtattcacagaggagaaccaatgggacagtgctagagctgctgttgaagatgaagaattctggaaactcgtggacagagaacgtgaactccacaaactgggcaagtgtggaagctgcgtttacaacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttatagtggagtagaaggggaaggactgcataagctgggatatatcttgagagatatttccaagatacccggaggagctatgtatgctgatgacacagctggttgggatacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaaggggcagtggacaggtgggaacttatggtctgaacacattcaccaacatggaagcccagttaatcagacaaatggaaggagaaggtgtgttgtcgaaggcagacctcgagaacccccatctgctagagaagaaaattacacaatggttggaagctgaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcgaagggatggcatgattggcaacaggtccctttctgctcccaccactttcatgaattgatcatgaaagatggaagaaagttggtagtcccctgcagaccccaggatgaattaatagggagagcgagaatctctcaaggggcaggatggagccttaaagaaactgcatgcctagggaaagcctacgcccaaatgtgggctctcatgtattttcacagaagagatcttagactggcatccaacgccatatgttcagcagtaccagtccattgggtccccacaagcaggacgacgtggtccattcatgctcaccatcagtggatgactacagaagacatgcttactgtttggaacagggtgtggatagaggataatccatggatggaagacaaaactccagtcacaacttgggaagatgtaccatatctagggaagagagaagaccaatggtgcggatcactcataggtcacacttccagagcaacctgggcccagaacatacttaccgcaatccaacaggtaagaagccttataggcaatgaagagtttctggactacatgccttcgatgaagagatttaggaaggaggaggagtcagagggagccatttggtaa

SEQ ID NO: 1279 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgtttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgcccccacattaccgaagtggagcctgaagacattgactgttggtgcaaccttacatcgacatgggtgacttatggaacatgcaatcaagctggagagcatagacgcgataagagatcagtggcgttagctccccatgtcggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtgggagtaggaaacagagattttgtggaaggcctatcgggagctacgtgggttgacgtggtgctcgagcacggtgggtgtgtgactaccatggctaagaacaagcccacgctggacatagagcttcagaagactgaggccactcagctggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagttacggctgagataacatcccaggcatcaaccgctgaagccattttacctgaatatggaaccctcgggctagaatgctcaccacggacaggtttggatttcaatgaaatgattttattgacaatgaagaacaaagcatggatggtacatagacaatggttctttgacttacccctaccatggacatcaggagctacaacaaaaacaccaacttggaacaggaaagagcttcttgtgacatttaaaaatgcacatgcaaaaaagcaagaagtagttgtccttggatcacaagagggagcaatgcatacagcactgacaggagctacagagatccaaacctcaggaggcacaagtatttttgcggggcacttaaaatgtagactcaagatggacaaattgaaactcaaggggatgagctatgcaatgtgcttgaatacctttgtgttgaagaaagaagtctccgaaacgcagcatgggacaatactcattaaggttgagtacaaaggggaagatgcaccctgcaagattcctttctccacggaggatggacaagggaaagctcacaatggcagactgatcacagccaatccagtggtgaccaagaaggaggagcctgtcaacattgaggctgaacctccttttggggaaagtaatatagtaattggaattggagacaaagccctgaaaatcaactggtacaggaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttagtggagtctcctggataatgaaaattggaataggtgtcctcttaacctggatagggttgaattcaaaaaacacttctatgtcattttcatgcattgcgataggaatcattacactctatctgggggtcgtggtgcaagctgacatggggtgtgtcataaactggaaaggcaaagaactcaaatgtggaagtggaattttcgtcactaatgaggtccacacctggacagagcaatacaaatttcaagcagactcccccaaaagagtggcaacagccattgcaggcgcttgggagaatggagtgtgcggaattaggtcaacaaccagaatggagaacctcttgtggaagcaaatagccaatgaactgaactacatattatgggaaaacgacattaaattaacggtagttgtaggcgacataactggggtcttagagcaagggaaaagaacactaacaccacaacccatggagctaaaatattcttggaaaacatggggtttggcaaaaatagtgacagctgaaacacaaaattcctctttcataatagatgggccaagcacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaagctagaaaaagcatccctcatagaggtgaaaacctgcacatggccaaaatcacacactctttggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaatcagacccattaatgagaaagaagagaacatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagaggcatggcgcacacactcataatgattgggtccaacgcctctgacagaatggggatgggcgtcacttacctagctctaattgcaacatttaaaattcagccattcttggctttgggattcttcctgaggaaactgacatctagagaaaatttattgctgggagttgggttggccatggcagcaacgttacgactgccagaggacattgaacaaatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagttccacccctaccactttttattttcagtctgaaagatacactcaaaaggagaagctggccactgaatgagggggtgatggcagttggacttgtgagcattctagctagttctctccttaggaatgatgtgcccatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatgatcacagttgatgatgatggaacaatgagaataaaagatgacgagactgagaacatcttaacagtgcttttaaaaacagcactactaatagtatcaggcatctttccatactccatacccgcaacaatgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcacgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgttagtggaatagcgcaaacaaatgcagaaccagatggaccgacaccagagttggaagaagagatgttcaaaaagcgaaatctaaccataatggatcttcatcctgggtcaggaaagacgcggaaatatcttccagctattgttagagaggcaatcaagagacgcttaaggactctaattttggcaccaacaagggtagttgcagctgagatggaagaagcaatgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggctcatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgtcatagcaaactgtttgcggaaaaatggaaaaaaggtcattcaactcagcaggaagacctttgacacagaatatcaaaagaccaaactgaatgattgggactttgtggtgacaacagacatttcagaaatgggagccaatttcatagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaaagatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggctcgatgcccgcacttattcagatcctttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcgtcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtccctggcagccatagctaaccaggcagtggtcctgatgggtttagacaaaggatggccgatatcgaaaatggacttgggcgtaccactattggcactgggttgctattcacaagtgaacccactaactcttatagcggcagtacttttgctagtcacacattatgcaattataggtccaggattgcaggcaaaagccactcgtgaagctcagaaaaggacagctgctggaataatgaagaatccaacggtggatggaataatgacaatagacctagatcctgtaatatatgattcaaaatttgaaaagcaactaggacaggttatgctcctggttctgtgtgcagttcaacttttgttaatgagaacatcatgggccttgtgtgaagttctaaccctagccacaggaccaataacaacactctgggaaggatcacctgggaagttctggaacaccacgatagctgtttccatggcgaacatctttagagggagctatttagcaggagctgggcttgctctttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcccgaaggaagagtcatagacttaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagtcttgaagatggttgaaccatggctaaaaaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaacatcgtctcttcagtcaacatggtatccagattgctactgaacagattcacaatgacacacaggagacccaccatagagaaagatgtggatttaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccatttggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggagttcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggagaggttaaaaagaatggccatcagcggggatgattgcgtagtgaaaccaatcgacgacagattcgccaatgccctgcttgccctgaacgatatgggaaaggttaggaaggacatacctcaatggcagccatcaaagggatggcatgattggcaacaggtccctttctgctcccaccactttcatgaattgatcatgaaagatggaagaaagttggtagttccctgcagaccccaggacgaactaataggaagagcgagaatctctcaaggagcaggatggagccttagagaaactgcatgtctagggaaagcctacgctcaaatgtggactctcatgtattttcacagaagagatcttagactagcatccaacgccatatgttcagcagtaccagtccattgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctaggaaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 1280 - DNA, 10173 bp, Dengue virus
atgaacaaccaacggaaaaagacgggaaaaccgtctatcaatatgctgaaacgcgtgagaaaccgtgtgtcaactggatcccagttggcgaagagattctcaagaggattgctgaatggccaaggaccaatgaaattggttatggcgttcatagctttcctcagatttctagccatcccaccaacagcaggagtcttggctagatggggaaccttcaagaagtcaggggctattaaggtcctaaaaggcttcaagaaggagatttcaaacatgctgagcattatcaacaaaaggaaaaagacatcgctctgtctcatgatgatattaccagcaacacttgctttccacttgacttcacgcgatggagagccacgcatgattgtggggaagaatgaaagagggaaatccctactttttaagacagcttctggaatcaacatgtgcacactcatagccatggacttgggagagatgtgtgatgacacggtcacctacaaatgccccctcattgccgaagtggaacctgaagacattgactgctggtgcaaccttacatcgacatgggtgacttatggaacgtgcaatcaagccggggagcatagacgcgacaaaagatcagtggcgttagctccccatgtcggcatgggactggacacacgcacccaaacctggatgtcggctgaaggagcttggagacaagtcgagaaggtagagacatgggctcttaggcacccagggttcaccatattagccctatttcttgctcattacataggcacttctctgacacagaaagtggttatttttatactactaatgctggtcaccccatccatgacaatgagatgcgtgggagtaggaaacagagattttgtggaaggtctgtcgggagctacgtgggttgatgtggtgctcgagcacggtgggtgtgtgaccaccatggctaagaacaagcctacgctggacatagagcttcagaagaccgaggccacccaactggcgaccctaaggaagttgtgcattgagggaaaaattaccaacataacaactgattcaaggtgtcctacccagggggaagcgattctacctgaggagcaggaccagaactacgtatgtaagcacacatacgtggatagaggctggggaaacggttgtggtttgtttggcaagggaagcttggtgacatgcgcgaaatttcaatgtttagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgttgaagccatcttgcctgaatatggaacccttgggctagaatgctcaccacggacaggtttggatttcaatgaaatgattttattgacaatgaagaacaaagcatggatggtacataggcaatggttctttgacctacccctaccatggacatcaggagctacaacagaggcaccaacttggaacaggaaagagcttcttgtgacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatgggcaagggaaagctcacaatggtagactgatcacagccaacccagtggtgaccaagaaggaggagcctgtcaacattgaggctgaacctccttttggggaaagtaacatagtgattggaattggagacaaagccttgaaaattaattggtacaagaagggaagctcgattgggaagatgttcgaggccactgccagaggtgcaaggcgcatggccatcttgggagacacagcttgggactttggatcagtgggtggtgttctaaattcattagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgcgataggaattattacactctatctgggagccgtggtacaagctgacatggggtgtgtcataaactggaaaggaaaagaactcaaatgtggaagcggaattttcgtcactaatgaggtccacacctggacagagcagtacaaatttcaagcagactcccctaaaagactggcgacagccatcgcaggcgcttgggaaaatggagtctgtggaatcaggtcgacaaccagaatggagaatctattgtggaagcaaatagccaatgagctgaactacatattatgggaaaacaacatcaaactaacggtagttgtgggcgacataattggggttttagagcaagggaaaagaacactaacaccacaacccatggagctaaaatattcatggaaaacatggggaaaggcaaaaatagtgacagctgagacacaaaattcctccttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcacgccgacatgggctattggatagaaagccaaaagaatggaagttggaagctagaaaaagcatccttcatagaggtgaaaacctgtacttggccaaaatcacacactctttggagcaatggtgtattagagagtgacatgatcatcccaaagagtctagctggtcctatttcacaacacaaccacaggcccgggtaccacacccaaacggcaggaccctggcacttgggaaaattggagctggacttcaactattgtgaaggaacaacagtagtcatcacagaaaactgtgggacaagaggcccatcattgagagcaacaacagtgtcagggaagttgatacacgaatggtgttgccgctcgtgcacacttcctcccttgcgatacatgggagaggacggctgttggtatggcatggaaattagacctgtcaatgagaaagaagagaacatggtaaagtctttagtctcagcagggagtggaaaggtggacaacttcacaatgggagtcttgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctgcctagctttaattgcaacattcaaaattcagccattcttggctttgggattcttcctgaggaaattgacatccagagaaaatttgctgttgggagttgggttggccatggcaacgacgctacaactgccagaggacattgaacaaatggcgaatggaattgctctggggctcatgactctaaaactgataacacaatttgagacataccagttatggacggcattagtctccctaacgtgttcaaacacaatcttcacgttgactgttgcctggagaacagccaccttgattctggccggagtttcgcttttgccagtgtgccagtcttcgagcatgaggaaaacagattggcttccaatgactgtggcagctatgggagttccacccttaccactctttatcttcagcttgaaggatgcactcaaaaggaggagctggccactgaatgagggggtgatggctgttgggcttgtgagcattctagctagttctctccttaggaatgatgtgcccatggctggaccactagtggccgggggcttgctgatagcgtgttatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcttaacagtgctcttaaaaacagcattactaatagtatcaggcatctttccatactccatacccgccacactgttggtctggcatacttggcaaaagcaaacccaaagatctggtgttctatgggacgtacccagccccccagaaacacagaaagcagaactggaagagggggtctataggatcaaacaacaaggaatttttgggaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaacttccaaactatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagagagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaacagctgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcgaaaaaatggaaaaaaggtcatccaacttagtaggaagacctttgatacagaatatcaaaagaccaaactgaatgattgggacttcgtggtgacaacagacatttcagaaatgggagccaacttcaaagcagacagagtgatcgacccaagaagatgtctcaagccagtgattttgacagatggacccgagcgggtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagataacatcaacaccccagaagggattataccagctctctttgaaccagaaagggagaagtcagccgccatagacggtgaataccgcctgaagggtgagtccaggaagaccttcgtggaactcatgaggaggggtgacctcccagtttggttagcccataaagtagcatcagaagggatcaaatacacagatagaaaatggtgctttgatggggaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctagacaatttggtgatgctgcacacatcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgcttccagtggcatgttatggatggctgatgtcccacttcaatggatcgcgtcggctatagtcctggaatttttcatgatggtgttgctcataccagaaccagaaaagcagagaactccccaagacaaccaactcgcatatgtcgtgataggcatacttacactggctgcaatagtagcagccaatgaaatgggactattggaaactacaaagaggaatttaggaatgtctaaagaaccaggtgttgtttctccaaccagctatttagatgtggacttgcacccagcatcagcctggacattgtacgccgtggccacaacagtaataacgccaatgttgagacataccatagagaattccacagcaaatgtgtccctggcagccatagctaaccaggcagtggtcctgatgggtttagacaaaggatggccaatatcgaaaatggacctaggcgtaccactactggcactgggctgctattcacaagtgaacccactgactctcacagcggcagtacttctgctagttacacattatgccattataggtccaggattgcaggctaaagccactcgtgaagctcagaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttaatgaaaacatcatgggccttgtgtgaagttctaaccctagccacaggaccaataacaacactctgggaaggatcacctgggaagttctggaacaccacgatagctgtttccatggcgaacatctttagagggagctatttagcaggagctggacttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcccgaaggaagagtcatagacttaggctgtggaagaggaggctggtcatattactgtgcaggactgaaaaaagttacagaagtgcgaggatacacaaaaggcggcccaggacacgaagaaccagtacctatgtctacatacggatggaacatagttaagttaatgagtggaaaggatgtgttttatcttccacctgaaaagtgtgacaccctattgtgtgacattggagaatcttcaccaagcccaacagtggaagaaagcagaaccataagagttttgaagatggttgaaccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtaaacatggtatccagattgctactgaacagatttacaatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggtgcccatggtgacacagatggcaatgacagatacaaccccatttgggcagcaaagagttttcaaagagaaagtggataccaggacacccaggcccatgccagggacaagaaaggttatggagatcacagcggaatggctttggagaaccctgggaaggaacaaaagacccagactgtgcacaagggaagagttcacaaaaaaggtcaggaccaacgcggctatgggagccgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaaaaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcataagctgggatacattttaagagacatttccaagatacctggaggagctatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaacccccatccgctagagaagaaaatcacacaatggttggaaaccaaaggagtggagagattaaaaagaatggctatcagcggggatgattgcgtggtgaaaccgattgatgacaggtttgccaatgccctgttagccctgaacgatatgggaaaggttaggaaggacatacctcaatggcagccatcaaagggttggcatgattggcaacaggtccctttctgctcccaccactttcatgaactgatcatgaaagatggaagaaagttggtggttccctgcagaccccaggacgaactaataggaagagcgagaatttctcaaggagcaggatggagcctcaaagaaactgcatgtttagggaaagcctacgctcaaatgtggagtctcatgtattttcacagaagagatcttagactggcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcatagcaatccaacaggtgagaagccttataggcgatgaagagtttctggactacatgccttcgatgaagagattcaggaaggaggaggagtcagagggagccatttggtaa

SEQ ID NO: 1281 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggactgctgaacggccaaggaccaatgaaattggttatggcgttcatagctttcctcagatttctagccattccaccgacagcaggagtcttggctagatggggaacctttaagaagtcgggggctattaaggtcctgagaggcttcaagaaggagatctcaaacatgctgagcattatcaacagacggaaaaagacatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagagatgtgtgatgacacggtcacctacaaatgccccctcattactgaagtggagcctgaagacattgactgctggtgcaaccttacatcgacatgggtgacctacggaacgtgcaatcaagctggagagcacagacgcgacaaaagatcggtggcgttagctccccatgtcggcatgggactggacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgcgtgggagtaggaaacagagattttgtggaaggcctatcaggagctacgtgggttgacgtggtgctcgagcacggtgggtgtgtgactaccatggctaagaacaagcccacgctggatatagagctccagaagaccgaggccacccaactggcgaccctaaggaaactatgtattgagggaaaaattaccaacgtaacaaccgactcaaggtgccccacccaaggggaagcgattttacctgaggagcaggaccagaaccacgtgtgcaagcacacatacgtggacagaggctggggaaacggttgtggtttgtttggcaagggaagcctggtaacatgcgcgaaatttcaatgtttggaatcaatagagggaaaagtggtgcagcatgagaacctcaaatacaccgtcatcatcacagtgcacacaggagatcaacaccaggtgggaaatgaaacgcagggagtcacggctgagataacaccccaggcatcaaccgttgaagccatcttacctgaatatggaacccttgggctagaatgctcaccacggacaggtttagatttcaatgaaatgattttgttgacaatgaagaacaaagcatggatggtacatagacaatggttttttgacctacctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgcctttgtgttgaagaaagaagtctccgaaacgcaacatgggacaatactcatcaaggttgagtacaaaggggaagatgcaccttgcaagattcctttctccacggaggatggacaagggaaagcccacaatggcagactgatcacagctaacccagtggtgaccaagaaggaggagcctgtcaatattgaggcagaacctccttttggggaaagcaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaaaagactggcgacagccattgcaggcgcttgggagaatggagtgtgcggaatcaggtcgacaaccagaatggagaacctcttgtggaagcaaatagccaatgaactgaactacatattatgggaaaacaacatcaaattaacggtagttgtgggtgatataattggggtcttagagcaagggaaaagaacactaacaccacaacccatggaactaaaatattcatggaaaacatggggaaaggcgaagatagtgacagctgaaacacaaaattcctctttcataatagatgggccaaacacaccagagtgtccaagtgcctcaagagcatggaatgtgtgggaggtggaagattacgggttcggagtcttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgagaacaacaacagtgtcagggaagttgatacacgaatggtgttgccgctcgtgtacacttcctcccctgcgatacatgggagaagacggctgctggtatggcatggaaattagacccattaatgagaaagaagagaacatggtaaagtctttagtctcagcagggagtggaaaggtggataacttcacaatgggtgtcttgtgtttggcaatcctttttgaagaggtgatgagaggaaaatttgggaaaaagcacatgattgcaggggttctcttcacgtttgtactccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccggaatttctcttttgccagtgtgccagtcttcgagcatgaggaaaacagattggctcccaatggctgtggcagctatgggagttccacccctaccactttttattttcagtttgaaagatacgctcaaaaggagaagctggccactgaatgagggggtgatggctgttggacttgtgagtattctagctagttctctccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagactgagaacatcttaacagtgcttttgaaaacagcattactaatagtgtcaggcatttttccatactccatacccgcaacactgttggtctggcacacttggcaaaagcaaacccaaagatccggtgtcctatgggacgttcccagccccccagagacacagaaagcagaactggaagaaggggtttataggatcaagcagcaaggaatttttgggaaaacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggaaattgagtgcacaatggcaaaaaggagaggaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtactgggattgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgataataatggatgaggctcatttcacagacccagccagtatagcggctagagggtacatatcaactcgtgtaggaatgggagaggcagccgcaattttcatgacagccacaccccctggaacagctgatgcctttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaagactaaactaaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcgcaaaggagagggagagttggcaggaacccacaaaaagaaaatgaccaatacatattcatgggccagcccctcaataatgatgaagaccatgctcactggacagaagcaaaaatgctgctagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatatacagatagaaagtggtgttttgatggagaacgcaacaatcaaattttagaggagaatatggatgtggaaatctggacaaaggaaggagaaaagaaaaaattgagacctaggtggcttgatgcccgcacttattcagatcccttagcgctcaaggaattcaaggactttgcggctggtagaaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcttactcctgggactcatgatcctgttaacaggtggagcaatgcttttcttgatatcaggtaaagggattggaaagacttcaataggactcatttgtgtagctgcttccagcggtatgttatggatggctgatgtcccactccaatggatcgcgtctgccatagtcctggagttttttatgatggtgttacttataccagaaccagaaaagcagagaactccccaagacaatcaactcgcatatgtcgtgataggcatactcacactggctgcaatagtagcagccaatgaaatgggactgttggaaaccacaaagagagatttaggaatgtccaaagaaccaggtgttgtttctccaaccagctatttggatgtggacttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgttattcacaagtgaacccactaactctcacagcggcagttctcctgctagtcacgcattatgctattataggtccaggattgcaggcaaaagccactcgtgaagctcaaaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagagggacagggtcacagggtgaaaccttgggagaaaagtggaaaaagaaattgaatcaattaccccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaggatgtgttttatcttccacctgaaaagtgtgatactctattgtgtgacattggagaatcttcaccaagcccaacagtggaagaaagcagaaccataagagtcttgaagatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaatatcgtttcttcagtcaacatggtatccagattgctacttaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacctatgccaggaacaagaaaggttatggagatcacagcggaatggctttggagaaccctgggaaggaacaaaagacccagattatgtacgagagaggagttcacaaaaaaggtcagaaccaacgcagctatgggcgccgtttttacagaggagaaccaatgggacagtgctagagctgctgttgaggatgaagaattctggaaactcgtggacagagaacgtgaactccacaaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcacaagctgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttaatcagacaaatggaaggagaaggtgtgttgtcgaaggcagacctcgagaaccctcatctgctagagaagaaagttacacaatggttggaaacaaaaggagtggagaggttaaaaagaatggccatcagcggggatgattgcgtggtgaaaccaattgatgacaggttcgccaatgccctgcttgccctgaatgacatgggaaaagttaggaaggacatacctcaatggcagccatcaaagggatggcatgattggcaacaggtccctttctgctcccaccactttcatgaattgatcatgaaagatggaagaaagttggtagttccctgcagacctcaggatgaattaatcgggagagcgagaatctctcaaggagcaggatggagccttagagaaactgcatgcctagggaaagcctacgcccaaatgtggactctcatgtactttcacagaagagatcttagactagcatccaacgccatatgttcagcagtaccagtccattgggtccccacaagcagaacgacgtggtctattcatgctcaccatcagtggatgactacagaagacatgcttactgtttggaacagggtgtggatagaggataatccatggatggaagacaaaactccagtcaaaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcgatgaagagattcaggaaggaggaggagtcagagggagccatttggtaa

SEQ ID NO: 1282 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaagacatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaataaagcatggatggtacatagacaatggttttttgacttacctctaccatggacatcaggggctacaacagaaacaccaacctggaataagaaagagcttcttgtgacattcaaaaatgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggacaaattggaacttaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtcctcttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgtggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaactccgagagatgtacacccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtagataacttcacaatgggtgtcttgtgtcttgcaatcctctttgaagaggtaatgagaggaaaattcgggaaaaagcacatgattgcaggggttctcttcatatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccctggggctcatggctcttaaattgataacacaatttgaaacataccaactatggacggcattagtctccctaacgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtgcccagccccccagagacacagaaagcagaactggaagaaggggtctataggatcaagcagcgaggaatttttggaaagacccaagtgggggttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattctggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaatgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaatttcaaagcagacagagttatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacactcttactcctgggactcatgatcctgttgacaggtggggcgatgcttttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttagggatgtccaaagaaccaggtgttgtttcgccaaccagctatttggatgtggatttgcacccagcatcagcctggacattgtatgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagttatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatccagaggcagcgcaaaacttcaatggttcgtggagagaaacatggtcattcctgaagggagagtcatagacttgggctgtggaagaggaggctggtcatattattgtgcaggattgaaaaaagttacagaagtgcgagggtacacaaaaggcggcccaggacatgaagaaccagtacctatgtctacgtatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcatcaaagtattgaacccttacatgccaactgtgattgagcacctagaaagactacaaaggaaacatggaggaatgcttgtgagaaatccactttcacgaaactccacgcacgaaatgtactggatatctaatggcacaggcaacatcgtctcttcagtgaacatggtatccagactgctactgaacagattcacaatgacatataggagacccaccatagaaaaagatgtggatttaggagcggggacccgacatgtcaacgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggtcatggagatcacagcggaatggctttggagaaccctgggaaggaacaaaagacccagattatgcacaagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaattgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgatacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaactctcatctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaagtccctttctgctcccaccactttcatgaattaattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccaccagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 1283 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaagacatcgctctgtctcatgatgatgttaccagcaacacttgctttccacttgacttcacgagatggagagccgcgcatgattgtggggaagaatgagagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggtatgggactggacacacgcgcccagacctggatgtcggctgaaggagcttggagacaagttgagaaggtagagacatgggcctttaggcatccagggttcacaatactagccctatttcttgcccattacataggcacttccttgacccagaaagtggtcattttcatactactaatgctggtcaccccatccatgacaatgagatgtgtgggagtgggaaacagagattttgtggaaggcctatcaggagctacgtgggttgacgtggtgctcgaacacggtgggtgtgtgactaccatggctaagaacaagcccacgctggacatagagctccagaagaccgaggccacccaactggcaaccctaaggaaactatgtattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcaaaatttcaatgtttggaattgatagagggaaaagtggtgcagcatgagaacctcaaatacaccgtcatcatcacagtgcatacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaacgcacacgcaaaaaaacaagaggtagtagtccttggatcgcaagagggagcaatgcacacagcattgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtaaccaagaaggaggagcccgtcaatattgaggcagaacctccttttggggaaagtaatataataattggaataggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggcactttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactccccaaaaagattggcgacagccattgcaggcgcctgggagaatggagtgtgcggaatcaggtcgacaaccagaatggagaacctcttatggaagcaaatagccaatgaactaaactacatactatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaagctccgagaaatgtactcccaactatgtgaccataggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaattacaggcccggataccacacccaaacggcaggaccatggcacctaggaaaattggagctggacttcaactattgtgaaggaacaacagttgtcatcacagaaaattgtgggacaagaggtccatcactgaggacaacaacagtgtcagggaaattgatacacgaatggtgttgccgctcatgtacacttcctcccctgcgatatatgggagaagacggctgctggtatggcatggaaattagacccatcaatgagaaagaagagaacatggtaaagtctttagtctcagcagggagtggaaaggtggataacttcacaatgggtgtcttgtgtcttgcaatcctctttgaagaggtaatgagaggaaaattcgggaaaaagcacatgattgcaggggttctcttcacatttgtgctccttctctcagggcaaataacatggagagacatggcacgcacactcataatgattggatccaacgcctctgacagaatgggaatgggcgtcacttacctagcattgattgcaacatttaaaattcagccatttttggctttgggattcttcctgaggaaactgacatctagagaaaatttgttattgggagttgggttagccatggcaacaacgttgcaactgccagaggacattgaacaaatggcgaatggaatagccttggggctcatggctcttaaattgataacacaatttgaaacataccaactatggacggcattagtctccctaatgtgttcaaacacaatttttacgttgactgttgcctggagaacagccaccctgattttggccggaatttcgcttttgccattgtgccagtcttcgagcatgaggaaaacagattggcttccaatgactgtagcagctatgggagttccacctctaccactttttattttcagtctgaaagacacactcaaaaggagaagctggccactgaatgaaggggtgatggccgtaggacttgtgagcattctagcaagttctctccttaggaatgacgtacccatggctggaccattagtggctgggggcttgctgatagcgtgctatgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattgctaatagtgtcaggcatttttccatactccatacctgcaacacttttggtctggcacacttggcaaaagagaacccaaagatccggcgtcctgtgggacgtacccagtcccccagagacacaaaaagcagaactggaagaaggggtctataggatcaagcagcaaggaattcttggaaagacccaagtgggggttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaagggagaagaggtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaaccgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttccccagagcaacgctccaattcaagatgaagaaagagacataccagaacgctcatggaattcaggcaatgattggattaccgactttgccggaaagactgtgtggtttgtccccagcatcaaagctgggaatgacatagcaaactgcctgcggaaaaatggaaaaaaggtcattcaacttagtaggaaaacttttgacacagaatatcaaaagactaaactaaatgattgggactttgtggtgacaacagacatttcagagatgggagccaatttcaaagcagacagagtgatcgacccaagaagatgtctcaagccagtcattttgacagacggacccgagcgcgtgatcctggcgggaccaatgccagtcaccgtagcgagtgccgcgcaaaggagagggagagttggcaggaacccacaaaaagaaaatgaccaatacatattcacgggccagcctctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaacatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagagcacggtgggagggcctacaggcatgcagtggaggaattaccagaaacaatggaaacactcttactcctgggactcatgattctgttaacaggtggggtgatgcttttcttgatatcaggcaaaggggtcggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggactgttggaaaccacaaagagagatttggggatgtccaaagaaccaggtgtcgcttcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggctgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatggaataatgacaatagacctagatcctgtaatatacgattcaaaatttgagaaacaattaggacaagttatgctcctggttctgtgtgcagttcaacttttgttaatgagaacatcatgggcattttgtgaagctctaaccctagccacaggaccaataacaacactctgggaaggatcacctgggaagttctggaacactacgatagctgtttccatggcgaacatctttagagggagctatttagcaggagctgggcttgctttttctatcatgaaatcagttggaacgggaaagagaggaacagggtcacaaggtgaaactttgggagaaaagtggaaaaagaaattgaatcaattatcccggaaagagtttgatctctacaagaaatccggaatcactgaagtggatagaacagaagccaaagaagggttgaaaagaggagagataacacaccatgccgtatccagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtccacatatggatggaacatagtcaagctgatgagtggaaaggatgtgttttatctcccacctgaaaagtgtgacactctattgtgtgacattggagaatcttcaccaagcccaacagtggaggagagcagaaccataagagtcttgaaaatggttgaaccatggctaaaaaataaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacctaccatagagaaagatgtggatttaggagcggggacccggcatgtcaatgcggaaccagaaacacccaacatggatgtcattggggaaagaataagaaggatcaaggaggagcatagttcaacatggcactatgatgatgagaatccttacaagacgtgggcttaccatggatcttatgaagttaaggccacaggctcagcctcctccatgataaatggagtcgtgaaactcctcacgaaaccatgggatgtggtgcccacggtgacacagatggcaatgacggacacgaccccttttggccagcaaagggtttttaaagaaaaagtggacaccaggacacccaaacccatgccaggaacaagaaaggtcatggagatcacagcggaatggctttggagaaccctgggaaggaacaaaagacccagattatgcacgagagaggagttcacaaaaaaggtcagaaccaacgcagctatgggcgccgtgttcacagaggagaaccaatgggacagtgctaaagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagccatgtatgctgacgacacagctgggtgggacacaagaataacagaagatgacctgcacaatgaggaaaaaatcacacagcaaatggaccctgaacacaggcagttagcaaacgctatatttaagctcacatatcaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtagtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaagatgaattaatagggagagcgagaatctctcagggagcaggatggagccttaaagaaactgcatgcctagggaaagcctacgcccaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttatcgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttactgcaatccaacaggtaagaagccttataggcaatgaagagtttctggactacatgccttcgatgaagagattcaggaaggaggaggagtcagagggagccatttggtaa

SEQ ID NO: 1284 - DNA, 10173 bp, Dengue virus
  misc_feature (6501)..(6501): n is a, c, g, or t
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagtattatcaacagacggaaaaagacatcgctctgtctcatgatgatgttaccagcaacacttgctttccacttgacttcacgagatggagagccgcgcatgattgtggggaagaatgagagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggtatgggactggacacacgcgcccaaacctggatgtcggctgaaggagcttggagacaagttgagaaggtagagacatgggcctttaggcatccagggttcacaatactagccctatttcttgcccattacataggcacttccttgacccagaaagtggtcatttttatactactaatgctggtcaccccatccatgacaatgagatgtgtgggagtgggaaacagagattttgtggaaggcctatcaggagctacgtgggttgacgtggtgctcgaacacggtgggtgtgtgactaccatggctaagaacaagcccacgctggacatagagctccagaagaccgaggccacccaactggcaaccctaaggaaactatgtattgagggaaaaatcaccaacgtgacaaccgactcaaggtgccccacccaaggggaagcgattctacctgaggagcaggaccagaactacgtgtgcaagcacacatacgtggacagaggctggggaaacggttgtggtttgtttggcaaggggagcttggtaacatgcgcaaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtgcatagacaatggttttttgacctacctctaccatggacatcaggggctacaacagaaacaccaacctggaataagaaagagcttcttgtgacattcaaaaacgcacacgcaaaaaaacaagaggtagtagtcctaggatcgcaagagggagcaatgcacacagcattgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccctgcaagattcctttctccacggaggatggacaagggaaagcccacaatggcagactgatcacagctaacccagtggtaaccaagaaggaggagcctgtcaacattgaggcagaacctccttttggggaaagtaatataataattggaataggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggcactttttagtggagtctcctggataatgaaaattggaataggtgtccttttaacttggatagggttgaattcaaaaaacacttctatgtcattttcatgcattgygataggaatcatcacactctatctgggagccgtggtgcaagctgatatggggtgtgtcataaactggaaaggcaaagaactcaaatgtggaagtggaattttcgttactaatgaggtccacacctggacagagcaatacaaatttcaagcagactccccaaaaagattggcgacagccattgcaggcgcctgggagaatggagtgtgcggaatcaggtcgacaaccagaatggagaacctcttatggaagcaaatagccaatgaactaaactacatactatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcaccactattatatggctgaagctccgagaaatgtactcccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaattacaggcccggataccacacccaaacggcaggaccatggcacctaggaaaattggagctggacttcaactattgtgaaggaacaacagttgtcatctcagaaaattgtgggacaagaggcccatcattgaggacaacaacagtgtcagggaaattgatacacgaatggtgttgccgctcatgtacacttcctcccctgcgatatatgggagaagacggctgctggtatggcatggaaattagacccatcaatgagaaagaagagaacatggtaaagtctttagtctcagcagggagtggaaaggtggataacttcacaatgggtgtcttgtgtcttgcaatcctctttgaagaggtaatgagaggaaaattcgggaaaaagcacatgattgcaggggttctcttcacatttgtgctccttctctcagggcaaataacatggagagacatggcacgcacactcataatgattggatccaacgcctctgacagaatgggaatgggcgtcacttacctagcattgattgcaacatttaaaattcagccatttttggctttgggattcttcctgaggaaactgacatctagagaaaatttgttattgggagttgggttagccatggcaacaacgttgcaactgccagaggacattgaacaaatggcgaatggaatagccttggggctcatggctcttaaattgataacacaatttgaaacataccaactatggacggcattagtctccctaatgtgttcaaacacaatttttacgttgactgttgcctggagaacagccaccctgattttggccggaatttcgcttttgccattgtgccagtcttcgagcatgaggaaaacagattggcttccaatgactgtagcagctatgggagttccacctctaccactttttattttcagtctgaaagacacactcaaaaggagaagctggccactgaatgaaggggtgatggccgtaggacttgtgagcattctagcaagttctctccttaggaatgacgtacccatggctggaccattagtggctgggggcttgctgatagcgtgctatgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagagaacccaaagatccggcgtcctgtgggacgtacccagtcccccagagacacagaaagcagaactggaagaaggggtctataggatcaagcagcaaggaattcttgggaaaacccaagtgggggttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaaaaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggttacaaagaatggtggctatgtcagtggaatagctcaaacaaacgcagaaccagacggaccgacaccagagttggaagaagagatgttcaaaaagcgaaatctaactataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaaccgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacacctcctggaacagctgatgcctttccccagagcaacgctccaattcaagatgaagaaagagacataccagaacgctcatggaattcaggcaatgattggattaccgactttgctgggaagactgtgtggtttgtccccagcatcaaagctgggaatgacatagcaaactgcctgcggaaaaatggaaaaaaggtcattcaacttagtaggaaaacttttgacacagaatatcaaaagactaaactaaatgattgggactttgtggtgacaacagacatttcagaaatgggagccaatttcatagcagacagagtgatcgacccaagaagatgtctcaagccagtcattttgacagaaggacccgagcgggtgatcctggcgggaccaatgccagtcaccgtagcgagcgccgcgcaaaggagagggagagttggcaggaacccacaaaaagaaaatgaccaatacatattcacgggccagcctctcaacaatgatgaagaccacgctcactggacagaagcaaaaatgctgctggacaacatcaacacaccagaagggattataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaacatggatgtggaaatctggacaaaggaaggagaaaagaaaaaattgaggcctaggtggcttgatgcccgcacttattcagatcctttagcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagagcacggtgggagggcctacaggcatgcagtggaggaattaccagaaacaatggaaacactcttactcctgggactcatgatcttgttaacaggtggggtgatgcttttcttgatatcagcnaaaggggtcggaaagacttcaataggactcatttgtgtarttgcttccagcggcatgttatgratggctgatatcccactccaatggatcgcgtcggccatagttctggagttttttatgatggtgctrctyataccagacccagaaaagcagagaactccccaagacaaccaactcgcatatgtcgtgataggcatacttacattggctgcaatagtagcagccaatgaaatgggactgttggaaaccacaaagagagatttggggatgtccaaagaaccaggtgtcgcttcgccaaccagctatttggatgtggaattgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggctgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatggaataatgacaatagacttagatcctgtaatatacgattcaaaatttgagaaacaattaggacaagttatgctcctggttctgtgtgcagttcaacttttgttaatgagaacatcatgggcattttgtgaagctctaaccctagccacaggaccaataacaacactctgggaaggatcacctgggaagttctggaacactacgatagctgtttccatggcgaacatctttagagggagctatttagcaggagctgggcttgctttttctatcatgaaatcagttggaacgggaaagagaggaacagggtcacaaggtgaaactttgggagaaaagtggaaaaagaaattgaatcaattatcccggaaagagtttgatctctacaagaaatccggaatcactgaagtggatagaacagaagccaaagaagggttgaaaagaggagagataacacaccatgccgtatccagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtccacatatggatggaacatagtcaagctgatgagtggaaaggatgtgttttatctcccacctgaaaagtgtgacactctattgtgtgacattggagaatcttcaccaagcccaacagtggargraagcagaaccataagagtcttgaaaatggttgaaccatggctaaaaaataaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacctaccatagagaaagatgtggatttaggagcgggaacccgacatgtcaatgcggaaccagaaacacccaacatggatgtcattggggaaagaataagaaggatcaaggaggagcatagttcaacatggcactatgatgatgaaaatccttacaagacgtgggcttaccatggatcttatgaagtaaaagccacaggctcagcctcctccatgataaatggagtcgtgaaactcctcacagaaccatgggatgtggtgcccacggtgacacagatggcaatgacggacacaaccccttttggccagcaaagggtttttaaagagaaagtggacaccaggacacctaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtgttcacagaggagaaccaatgggacagtgctaaagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagccatgtatgctgacgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtagtgaaaccaatcgacgacaggttcgccaatgccctgcttgccctgaatgacatgggaaaggttaggaaggacataccccaatggcagccatcgaagggatggcatgattggcaacaggtccctttctgctcccaccactttcatgaattgattatgaaagatggaagaaagttggtagtcccctgcagacctcaagatgaattaatagggagagcgagaatctctcagggagcaggatggagccttaaagaaactgcatgtctagggaaagcctacgcccaaatgtgggctctcatgtattttcacagaagagatcttagactagcatccaatgccatatgttcagcagtaccagtccattgggtccccacgagcagaacgacgtggtccatccatgctcaccatcagtggatgactacagaagacatgcttactgtctggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttactgcaatccaacaggtaagaagccttataggcaatgaagagtttctggactacatgccttcgatgaagagattcaggaaggaggaggagtcagagggagccatttggtaa

SEQ ID NO: 1285 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagcttttctcagatttctagccattccaccgacagcgggaatcttggctagatggggaaccttcaagaagtcgggggctattaaggtcctgagaggcttcaagagggagatctcaaatatgctgagcattatcaacagacggaaaaagacatcgctctgtctcatgatgatgttaccagcaacacttgctttccatttgacttcacgagatggagagccgcgcatgattgtggggaagaatgaaagaggaaaatccctactttttaagacagcctctgggatcaacatgtgcacactcatagccatggatttgggagagatgtgtgatgatacggtcacttacaaatgccccctcattactgaagtggagcctgaagacattgactgctggtgcaacctcacatcgacgtgggtgacttacggaacgtgcaaccaagctggagagcatagacgcgataaaagatcggtggcgttagctccccatgtcggcatgggactggacacacgtactcaaacctggatgtcggccgaaggagcttggagacaagtcgagaaggtagagacatgggcctttaggcacccagggttcaccatactagccctatttcttgcccattacataggcacttccttgacccaaaaagtggtcattttcatactgctaatgctggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagactgaggccacccaactggcgaccctaaggaaactatgcattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgctgaagccatcttacctgaatatggaaccctcgggctagaatgctcaccacggacaggtttggatttcaatgaaatgattttgttgacaatgaagaacaaagcatggatggtacatagacaatggttttttgacctacctctaccatggacatcaggggccacaacagaaacaccaacctggaataggaaagagcttcttgtgacattcaaaaacgcacacgcaaaaaaacaagaagtagtagtcctcggatcgcaagagggagcaatgcacacagcactgacaggagctacagagatccaaacctcaggaggcacaagtatttttgcggggcacttaaaatgcagactcaagatggacaaattgaaactcaaggggatgagctatgcaatgtgcttaaatgcctttgtgttgaagaaagaagtctccgaaacacaacatgggacaatactcattaaggttgagtacaaaggggaagatgcaccttgcaagattcctttctccacggaggatggacaagggaaagcccacaatggcagactgatcacagctaacccagtggtgaccaagaaggaagagcctgtcaatattgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcctggataatgaaaattggaataggtgtccttttaacctggatagggttgaattcaaaaaacacttctatgtcattttcatgcattgcgataggaatcattacactctatctgggagccgtggtgcaagctgacatggggtgtgtcataaactggaaaggcaaagaactcaaatggggaagtggaattttcgtcactaatgaggtccacacctggacagagcaatacaaatttcaagcagactcccccaaaagactggcgacagccatcgcaggcgcttgggagaatggagtgtgcggaatcaggtcgacaaccagaatggagaacctcttgtggaagcaaatagccaatgaactgaactacatattatgggaaaacaacatcaaattaacggtagttgtgggtgatacaattggggtcttagagcaagggaaaagaacactaccaccacaacccatggagctaaaatattcttggaaaacatgggaaaaggcgaaaatagtgacagctgaaacacaaaattcctctttcataatagatgggccaaacacaccagagtgtccaagtgcctcaagagcatggaatgtgtgggaggtggaagattatgggttcggagtcttcacaactaatatatggttgaaactccgagagatgtacacccaactatgtgaccacaggctaatgtcggcagccgttaaggatgagagagccgtacacgccgacatgggctattggatagaaagccaaaagaatggaagttggaagctagaaaaggcatcccttatagaggtgaaaacctgcacatggccaaaatcacacactctctggagcaatggtgtgctagagagcgacatgatcatcccaaagagtctggcaggtcctatttcgcaacacaactacaggcccggataccacacccaaacggcaggaccctggcacctaggaaaattggagctggacttcaattattgtgaaggaacaacagttgtcatcacagaaaattgtgggacaagaggcccatcactgaggacaacaacagtgtcagggaagttgatacacgaatggtgttgccgctcgtgtacacttcctcccctgcgatacatgggagaagacggctgctggtatggcatggaaattagacccattaatgagaaagaagagaacatggtaaagtctttagtctcagcagggagtggaaaggtggataacttcacaatgggtgtcttgtgtttggcaatcctctttgaagaggtgatgagaaggaaaattcggaaaaaacacatgattgcaggggtcctcttcacgtttgtgctcctcctctcagggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactaacatctagagaaaatttattgttgggagttgggttggccatggcaacaacgttacaactgccagaggacattgaacaaatggcgaatggaatagctttggggctcatggctcttaaattggtaacacaatttgaaacataccaactatggacggcattagtctccctaatgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacccctaccactttttatcttcagtttgaaagacacgctcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgatatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacccgcaacactgttggtctggcacacttggcaaaagcaaacccaaagatccggcgtcctatgggacgtacccagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatctcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactgtatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctattattagagaggcaatcaagagacgcttaaggactctaattttggcaccaacaagggtggttgcagctgagatggaagaagcattgaaggggctcccaataaggtatcaaacaactgcaacaaaatctgaacacacagggaaagagattgttgatctaatgtgtcacgcaacgttcacaatgcgtttgctgtcaccagttagagttccaaactataacttgataataatggatgaggctcatttcacagacccagccagtatagcggctagagggtacatatcaactcgtgtaggaatgggagaggcagccgcaattttcatgacagccacaccccctggtacagctgatgcctttcctcagagcaacgctccaattcaagatgaagaaagagacataccagaacgctcatggaattcaggcaatgactggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaggactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaataatgatgaagaccacgctcactggacagaagcaaaaatgctgctagacaacatcaacacaccagaagggattataccagctctctttgaaccagaaagggagaagtcagccgccatagacggcgaataccgcctgaagggtgaatccaggaagaccttcgtggaactcatgaggaggggtgacctcccagtttggctagcccataaagtagcatcagaaggaatcaaatatacagacagaaaatggtgttttgatggagaacgcaacaatcaaattttagaggagaatatggatgtggaaatctggacaaaggaaggagaaaagaaaaaattgaggcctaggtggcttgatgcccgcacttattcagatcctttagcgctcaaggaattcaaggactttgcagctggcagaaagtcgatcgcccttgatcttgtgacagaaataggaagagtgccttcacacttagcccacagaacgagaaacgctctggacaatctggtgatgctgcacacgtcagaacacggcgggagggcttacaggcatgcagtggaggaattaccagaaacaatggaaacactcttactcctgggactcatgatcttgttaacaggtggggcaatgcttttcttgatatcaggtaaggggattggaaagacctcaataggactcatttgcgtagttgcttccagcggtatgctatggatggctgatgtcccactccaatggatcgcgtcggccatagtcctggagttttttatgatggtgctacttataccagaaccagaaaagcagagaactccccaagacaaccaacttgcatatgtcgtgataggcatacttacattggctgcaatagtagcagccaatgaaatgggattgttggaaaccacaaagagagatttaggaatgtccaaagaaccaggtgttgtttctccaaccagctatttggatgtggatttgcacccagcatcagcctggacattgtacgctgtggccacaacggtaataacaccaatgttgagacataccatagagaattccacagcaaatgtgtccctggcagctatagccaaccaggcagtggtcctgatgggtttggacaaaggatggccgatatcgaaaatggacttaggcgtaccactattggcactgggttgctattcacaagtgaacccactaactctcacagcggcagtactcctgctagtcacgcattatgctattataggtccaggattgcaggcaaaagccactcgtgaagctcaaaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttgatgagaacatcatgggcattttgcgaagctctaaccctagccacaggaccaataacaacactctgggaaggatcacctgggaagttctggaacaccacgatagctgtttccatggcgaacatctttagagggagctacttagcaggagctgggcttgctttttccatcatgaaatcagttggaacaggaaagagaggaacagggtcacaaggtgaaaccttgggggaaaagtggaaaaagaaattgaatcaattatcccggaaagagtttgacctttacaagaaatccggaatcactgaagtggatagaacagaagccaaagaagggttgaaaagaggagaaataacacaccatgccgtatccagaggcagcgcaaaacttcaatggttcgtggagagaaacatggtcatccctgaaggaagagtcatagacctgggctgtggaagaggaggctggtcatattattgtgcaggactgaaaaaagttacagaagtgcgaggatacacaaaaggtggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtgttgaacccttacatgccaactgtgattgagcacctagaaagactacaaaggaaacatggaggaatgcttgtgagaaatccactctcacgaaactccacgcacgaaatgtactggatatccaatggcacaggcaacatcgtctcttcagtcaacatggtatccagactgttactgaacagattcacaatgacacacaggagacccaccatagagaaagatgtggatttaggagcggggacccgacatgtcaatgcggaaccagaaacacccaacatggatgtcattggggaaagaataaaaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccacggtgacacagatggcaatgacggatacaactccctttggccagcaaagggtttttaaagagaaagtggacaccaggacacctagacccatgccaggaacaagaaaggttatggagattacagcggaatggctttggagaaccctgggaaggaataaaagacccagattatgcacgagagaggagttcacaaaaaaggttagaaccaacgcagctatgggagccgtattcacagaggagaaccaatgggacagtgctagagctgccgttgaagatgaagaattctggaaacttgtggacagagaacgtgaactccacaaactgggcaagtgtggaagctgcgtttacaacatgatgggcaagagagagaaaaaactcggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagacatttccaagatacccggaggagccatgtatgctgatgacacagctggttgggacacaagaataacagaagatgacctgcacaatgaggaaaaaatcacacagcagatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcaaaggcagacctcgagaaccctcatctgctagagaagaaaattacacaatggttggaaactaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcgaagggatggcatgattggcaacaggtccctttctgctcccaccactttcatgaattgatcatgaaagatggaagaaagttggtagtcccctgcagacctcaggatgaattaatagggagagcgagaatctctcaaggggcaggatggagccttaaagaaactgcatgcctagggaaagcctacgcccaaatgtgggctctcatgtattttcacagaagagatcttagactagcatccaatgccatatgttcagcagtaccagtccattgggtccccacaagcaggacgacgtggtccattcatgctcaccatcagtggatgactacagaggacatgcttactgtttggaacagggtgtggatagaggataatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccctcgatgaagagattcaggaaggaggaggagtcagagggagccatttggtaa

SEQ ID NO: 1286 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcatcattaacagacggaaaaagacatcgctctgtctcatgatgatgttaccggcaacacttgctttccacttgacttcacgagatggagagccgcgcatgattgtggggaagaatgaaagaggaaaatccctactctttaagacagcctctggaattaacatgtgcacactcatagccatggatttgggagaaatgtgtgatgacacggtcacttacaaatgccccctcattactgaagtggagcctgaagacattgactgctggtgcaacctcacatcgacatgggtgacctacggaacgtgcaaccaagctggggagcatagacgcgacaagaggtcggtggcgttagctcctcatgtcggcatgggactggacacacgcgcccaaacctggatgtcggctgaaggagcttggagacaagtcgagaaggtagagacatgggcctttaggcacccagggtttacaatactagccctatttcttgcccattacataggcacctccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggccaagaacaagcccacgctggacatagagctccagaagaccgaggccacccaactggcaaccttaaggaaactatgcattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcgaaatttcaatgtttggaattaatagagggaaaagtggtgcaacatgagaacctcaaatacaccgtcatcatcacagtgcacacaggagaccaacaccaggtgggaaacgaaacgcagggagtcacggctgagataacaccccaggcatcaaccgtcgaagccatcttacctgaatatggaacccttgggctagaatgctcaccacggacaggtttggatttcaatgaaatgattttgttgacaatgaaaaacaaagcatggatggtacatagacaatggttttttgacctacctctaccatggacatcaggggctacaacagaaacacctacctggaataagaaagagcttcttgtgacattcaaaaatgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggataaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaaacaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaaaacaaaattcctcctttataatagatgggccaaacacaccagagtgtccaaatgcctcaagagcatggaatgtgtgggaggtggaagattacgggttcggagtcttcacaactaatatatggctgaaactccgagagatgtacacccaactatgtgaccacaggttaatgtcggcagccgttaaggatgagagagctgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaatcagacccattaatgagaaagaagagaacatggtaaagtctttagtctcagcagggagtggaaaggtggacaacttcacaatgggtgtcttgtgtcttgcaatcctctttgaagaggtaatgagaggaaaattcgggaaaaagcacatgattgcaggggttctcttcacatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcttgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaatgtgttcaaacacaattttcacgttgactgttgcctggagaacagccaccctgattttggccggaatttcgcttatgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtatcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggagcagtgttgacatacaatgggaaaagactggaaccaaactgggctagcgtgaaaaaagatctgatttcatacggaggaggatggagactgagtgcatactggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggtagcagctgagatggaagaagcattgaaagggctcccagtaaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaacgctccaattcaagatgaagaaagagacataccagaacgctcatggaattcaggcaatgattggatcaccgactttgcaggaaagactgtgtggtttgtccccagcatcaaagctgggaatgatatagcaaactgcttgcgaaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcacagtagcgagtgctgcgcaaaggagagggagagttggcaggaacccacaaaaagaaaatgaccaatacatattcacgggccagccccttaacaatgacgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgctttgatggagagcgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgattgcccttgatcttgtgacagaaataggaagagtgccttcacatttagctcacagaacgagaaacgctctggacaatttggtgatgttgcacacgtcagaacacggtgggagggcctacaggcatgcagtggaggaattaccagaaacaatggaaacactcttactcctgggactcatgatcctgttaacgggtggggcgatgcttttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttagggatgtccaaagaaccaggtgttgtttcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcattgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatccaggggcagcgcaaaacttcaatggttcgtggagagaaacatggtcattcctgaaggaagagttatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagggtcttgaaaatggttgaaccatggctaaaaaataaccagttttgcattaaagtattgaacccttacatgccaactgtgattgagcaccttgaaagactacaaaggaaacatggaggaatgcttgtgagaaatccactctcacgaaactccacgcacgaaatgtactggatatctaacggcacaggtaacatcgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccttgggaaggaacaaaagacccagattatgcacgagagaggagttcacaaaaaaggtcagaaccaacgcagctatgggcgccgtatttacagaggagaaccaatgggacagtgccagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccactggttctcgcgtgaaaactcttacagtggagtagaaggggaaggattgcataagctgggatacatcttgagagatatttccaagatacccggaggagccatgtatgctgatgacacagctgggtgggacacaagaataacagaagatgacctgcacaatgaggaaaaaatcacacagcaaatggaacctgaacacaggcagttagcaaacgctatttttaagctcacataccaaaacaaagtggtcaaagttcaacgaccaactccaaagggcacggtaatggacattatatctaggaaagaccaaagaggcagtggacaggtgggaacttatggtctgaatacattcaccaacatggaagcccaattgatcagacaaatggaaggagaagatgtgttgtcgaagacagacctcgagaaccctcatctgctggagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaaaggatggcatgattggcaacaagtccctttctgctcccaccactttcatgaattgattatgaaagatggaagaaagttggtagtcccctgcagacctcaggatgaattaatagggagagcgagaatctctcagggagcaggatggagccttaaagaaactgcatgtctagggaaagcctacgcccaaatgtgggccctcatgtattttcacagaagagatcttagactagcatccaatgccatatgttcagcagtaccagtccattgggtccccacaagcagaacgacgtggtccatccatgctcaccatcagtggatgactacagaagacatgcttaccgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaagagtcagagggagccatttggtaa

SEQ ID NO: 1287 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagtattatcaacagacggaaaaagacatcgctctgtctcatgatgatgttaccagcaacacttgctttccacttgacttcacgagatggagagccgcgcatgattgtggggaagaatgagagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggtatgggactggacacacgcgcccaaacctggatgtcggctgaaggagcttggagacaagttgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtgggaaacagagattttgtggaaggcctatcaggagctacgtgggttgacgtggtgctcgaacacggtgggtgtgtgactaccatggctaagaacaagcccacgctggacatagagcttcagaagaccgaggccacccaactggcaaccctaaggaaactatgtattgagggaaaaatcaccaacgtgacaaccgactcaaggtgccccacccaaggggaagcgattctacctgaggagcaggaccagaactacgtgtgcaagcacacatacgtggacagaggctggggaaacggttgtggtttgtttggcaagggaagcttggtaacatgcgcaaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtgcatagacaatggttttttgacttacccctaccatggacatcaggggctacaacagaaacaccaacttggaataagaaagagcttcttgtgacattcaaaaacgcacacgcaaaaaaacaagaggtagtagtcctaggatcgcaagagggagcaatgcacacagcattgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccctgcaagattcctttctccacggaggatggacaagggaaagcccacaatggcagactgatcacagctaccccagtggtaactaagatggaggagcccgtcaatattgaggcagaacctccttttggggaaagtaatataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggcactttttagtggagtctcctggataatgaaaattggaataggtgtccttttaacttggatagggttgaattcaaaaaacacttctatgtcattttcatgcattgtgataggaatcatcacactctatctgggagccgtggtgcaagctgatatggggtgtgtcataaactggaaaggcaaagaactcaaatgtggaagtggaattttcgttactaatgaggtccacacctggacagagcaatacaaatttcaagcagactcccccaaaagattggcgacagccattgcaggcgcttgggagaatggagtgtgcggaatcaggtcgacaaccagaatggagaacctcttatggaagcaaatagccaatgaactaaactacatactatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaagctccgagaaatgtactcccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaattacaggcccggataccacacccaaacggcaggaccatggcacctaggaaaattggagctggacttcaactattgtgaaggaacaacagttgtcatcacagaaaattgtgggacaagaggtccatcactgagaacaacaacagtgtcagggaaattgatacacgaatggtgttgccgctcatgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaatcctctttgaagaggtaatgagaggaaaatttgggaaaaagcacatgattgcaggggttctcttcacatttgtgctccttctctcagggcaaataacatggagagacatggcacgcacactcataatgattggatccaacgcctctgacagaatgggaatgggcgtcacttacctagcattgattgcaacatttaaaattcagccatttttggctttgggattcttcctgaggaaactgacatctagagaaaatttgttattgggagttgggttagccatggcaacaacgttgcaactgccagaggacattgaacaaatggcgaatggaatagccttggggctcatggctcttaaattgataacacaatttgaaacataccaactatggacggcattagtctccctaatgtgttcaaacacaatttttacgttgactgttgcctggagaacagccaccctgattttggccggaatttcgcttttgccattgtgccagtcttcgagcatgaggaaaacagattggcttccaatgactgtagcagctatgggagttccacctctaccactttttattttcagtctgaaagacacactcaaaaggagaagctggccactgaatgaaggggtgatggccgtaggacttgtgagcattctagcaagttctctccttaggaatgacgtacccatggctggaccattagtggctgggggcttgctgatagcgtgctatgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagagaacccaaagatccggcgtcctgtgggacgtacccagtcccccagagacacagaaagcagaactggaagaaggggtctataggatcaagcagcaaggaattcttggaaagacccaagtgggggttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaaaaacccaaagaactttcaaaccatgccaggcatttttcagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaactataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaaccgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacacctcctggaacagctgatgcctttccccagagcaacgctccaattcaagatgaagaaagagacataccagaacgctcatggaattcaggcaatgattggattaccgactttgccggaaagactgtgtggtttgtccccagcatcaaagctgggaatgacatagcaaactgcctgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgccgcgcaaaggagagggagagttggcaggaacccacaaaaagaaaatgaccaatacatattcacgggccagcctctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaacatggatgtggaaatctggacaaaggaaggagaaaagaaaaaattgaggcctaggtggcttgatgcccgcacttattcagatcccttagcgctcaaggaattcaaggattttgcggctggtagaaagtcaatcgcccttgatcttgtgacagaaataggaagagtgccttcacatttagcccacagaacgagaaacgctctggacaatctggtgatgytgcacacgtcagaacatggygggagggcctacaggcatgcagtggaggaaytaccagaaacratggaaacactcttactcctgggactcatgattctgttaacaggtggrgtaatgctyttcttgatatcaggyaaagggrtcggaaagacttcaataggactcatttgtgtagttgcttccagcggcatgttatggatggctgatatcccactccaatggatcgcgtcggctatagtcctggagttttttatgatggtgctacttataccagarccagaaaagcagagaactccccaagacaatcaactcgcatatgtcgtgataggcatacttacattggctgcaatagtagcagccaatgaaatgggactgttggaaacyacaaagagagatttrggaatgtcyaaagaaccaggtgtygyttctccaaccagctatttggatgtggayttgcacccagcatcagcctggacattgtacgccgtggccacaacagtaataacaccaatgttgagacataccatagagaattccacagcaaatgtgtccctggcagccatagccaaccaggcagtggtcctgatgggtttagacaaaggatggccgatatcgaaaatggacttaggcgtgccactattggcactgggctgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatggaataatgacaatagacttagatcctgtaatatacgattcaaaatttgagaaacaattaggacaagttatgctcctggttctgtgtgcagttcaacttttgttaatgagaacatcatgggcattttgtgaagctctaaccctagccacaggaccaataacaacactctgggaaggatcacctgggaagttctggaacactacgatagctgtttccatggcgaacatctttagagggagctatttagcaggagctgggcttgctttttctatcatgaaatcagttggaacgggaaagagaggaacagggtcacaaggtgaaactttgggagaaaagtggaaaaagaaattgaatcaattatcccggaaagagtttgatctctacaagaaatccggaatcactgaagtggatagaacagaagccaaagaagggttgaaaagaggagagataacacaccatgccgtatccagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtccacatatggatggaacatagtcaagctgatgagtggaaaggatgtgttttatctcccacctgaaaagtgtgacactctattgtgtgacattggagaatcttcaccaagcccaacagtggaaggaagcagaaccataagagtcttgaaaatggttgaaccatggctaaaaaataaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacctaccatagagaaagatgtggatttaggagcgggaacccggcatgtcaatgcggaaccagaaacacccaacatggatgtcattggggaaagaataagaaggatcaaggaggagcatagttcaacatggcactatgatgatgagaatccttacaagacgtgggcttaccatggatcttatgaagttaaggccacaggctcagcctcctccatgataaatggagtcgtgaaactcctcacgaaaccatgggatgtggtgcccacggtgacacagatggcaatgacggacacgaccccttttggccagcaaagggtttttaaagaaaaagtggacaccaggacacccaaacccatgccaggaacaagaaaggtcatggagatcacagcggaatggctttggagaaccctgggaaggaacaagagacccagattatgcacgagagaggagttcacaaaaaaggtcagaaccaacgcagctatgggcgccgtgttcacagaggagaaccaatgggacagtgctaaagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagccatgtatgctgacgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagtccaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtagtgaaaccaatcgacgacaggttcgccaatgccctgcttgccctgaatgacatgggaaaggttaggaaggacataccccaatggcagccatcaaagggatggcatgattggcaacaggtccctttctgctcccaccactttcatgaattgattatgaaagatggaagaaagttggtagtcccctgcagacctcaagatgaattaataggaagagcgagaatctctcaaggagcaggatggagccttaaagaaactgcatgtctagggaaagcctacgcccaaatgtgggctctcatgtattttcacagaagagatcttagactagcatccaatgccatatgttcagcagtaccagtccattgggtccccacgagcagaacgacgtggtccatccatgctcaccatcagtggatgactacagaagacatgcttatcgtctggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttactgcaatccaacaggtaagaagccttataggcaatgaagagtttctggactacatgccttcgatgaagagattcaggaaggaggaggagtcagagggagccatttggtaa

SEQ ID NO: 1288 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggactgctgaatggccaaggaccaatgaaattggttatggcgttcatagctttcctcagatttctagccattccaccgacagcgggaatcttggctagatggggatccttcaagaagtcgggggctgttaaggttctgagaggcttcaagaaggagatctcaaatatgctgagcattatcaacagacggaaaaagacatcgctctgtctcatgatgatgttaccagtaacacttgctttccacttgacttcacgagatggagagccgcgcatgattgtggggaagaatgaaagaggaaaatccttactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagatttcgtggaaggtctatcaggagctacgtgggttgacgtggtgcttgaacacggtgggtgtgtgactaccatggctaagaacaagcccacgctggacatagagctccagaagaccgaggccacccaactggcaaccctaaggaaactatgtattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcgaaatttcaatgtttggaatcaatagagggaaaagtggttcagcatgagaacctcaaatacaccgtcatcatcacagtgcacacaggagaccaacaccaggtgggaaatgaaacgcagggagtcacggctgaaataacaccccaggcatcaaccgtcgaagccatcttacctgaatatggaacccttgggctagaatgctcaccacggacaggtttggatttcaatgaaatgatcttgctgacaatgaagaacaaagcatggatggtgcatagacaatggttttttgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagctacagagatccaaacctcaggaggcacaagcatttttgcgggacacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaagagcctgtcaatattgaggcagaacccccttttggggaaagtaacataataattggaattggagacagagccttgaaaatcaattggtacaagaaggggagctcgattgggaagatgttcgaggccactgccaggggtgcaaggcgcatggccatcttgggagacacagcctgggattttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatttgggagccgtggtgcaagctgacatggggtgtgtcataaattggaaaggcaaagaactcaaatgtggaagtggaattttcgttactaatgaggtccacacctggacagagcaatacaaatttcaagcagactcccccaaaagactggcgacagccattgcaggcgcctgggagaatggagtatgcggaatcaggtcgacaaccagaatggagaacctcttgtggaagcaaatagccaatgaactaaactacatattatgggaaaacaacatcaaattaacggtagttgtgggtgacataattggggtcttagagcaagggaaaagaacactaacaccacaacccatggagctaaaatattcatggaaaacatggggaaaagcgaaaatagtgacagctgaaacacaaaattcctcctttataatagatgggccaaacacaccagagtgtccaaatgcctcaagagcatggaatgtgtgggaggtggaagattacgggttcggagtcttcacaactaatatatggctgaaactccgagagatgtacactcaactatgtgaccacaggctaatgtcggcagccgttaaggatgagagagccgtacacgccgacatgggctattggatagaaagccaaaagaatggtagttggaagctagaaaaggcatctctcatagaggtaaaaacctgcacatggccaaaatcacacactctctggagcaatggtgtgttggagagtgacatgatcatcccaaagagtctggctggtcctatctcgcaacacaactacaggcctggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcatgtacacttcctcccctgcgatatatgggagaagatggctgctggtatggcatggaaattagacccattaatgagaaagaagagaacatggtaaagtctttagtctcagcagggagtggaaaggtggataacttcacaatgggtgtcttgtgtcttgcaatcctcttcgaagaggtaatgagaggaaaattcgggaaaaagcacatgattgcaggggttctcttcacatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaatgtgttcaaacacaattttcacgttgactgttgcctggagaacagccaccctgattttggccggaatttcgctttttccagtgtgccagtcttcgagcatgaggaaaacagattggctcccaatgactgtggcagctatgggagttccacctttaccactttttattttcagtttgaaagacacactcaaaaggagaagctggccactgaatgagggggtgatggccgttggacttgtgagtattctagcaagttctctccttaggaatgacgtacccatggctggaccattagtggctgggggcttgctgatagcgtgctacgtcataactggcacgtcagcagacctcactgtagaaaaagcagcagatgtgacgtgggaggaagaggctgagcaaacaggagtgtcccacaatctaatgatcacagttgatgatgatggaacaatgagaataaaagatgatgagactgagaacattttaacagtgcttttgaaaacagcattactaatagtgtcaggcatttttccatactccatacctgcaacacttctggtttggcacacttggcaaaagcaaacccaaagatccggcgtcctgtgggacgtacccagccccccagagacacagaaagcagaactggaggaaggggtctataggatcaagcagcaaggaatttttggaaagacccaagtgggggttggagtacaaaaagaaggagttttccacactatgtggcacgtcacaagaggagcagtgttgacatacaatggaaaaagattggaaccaaactgggctagcgtgaaaaaagatctgatttcatacggaggaggatggagactaagtgcacaatggcaaaaaggagaagaggtgcaggttattgccgtagagcctgggaagaacccaaagaactttcaaaccatgccaggcattttccagacaacaacaggggagataggagcgattgcactggactttaagcctggaacttcaggatctcctatcataaacagagagggaaaggtagtgggactatatggcaatggagtggttacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagccatagttagagaggcaatcaagagacgcttaaggactctaattttggcaccaacaagggtggttgcagctgagatggaagaagcattgaaagggctcccaataaggtatcaaacaaccgcaacaaaatctgaacacacagggaaagagattgttgatctaatgtgccacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacggccacacctcctggaacagctgatgcctttcctcagagcaacgctccaattcaagatgaagaaagagacataccagaacgctcatggaattcaggcaatgattggattaccgactttgctggaaagactgtgtggtttgtccccagcatcaaagctgggaatgacatagcaaactgcttgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgatccaagaagatgtctcaagccagtcattttaacggacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcgaaaatgctgctagacaacatcaacacaccagaaggaatcataccagctctctttgaaccagaaagggaaaagtcagccgctatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggaaaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatctagcccacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgcttttcttgatatcaggcaaaggggttggaaagacttcaataggactcatttgtgtagttgcttccagcggcatgttatggatggctgatatcccactccaatggatcgcgtcggccatagtcctggagtttttcatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtttcgccaaccagctatttggatgtggatttacacccagcatcagcctggacactgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgactcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatctagcaggagctgggcttgctttttctatcatgaagtcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatccagaggcagcgcaaaacttcaatggttcgtggagagaaacatggtcattcctgaaggaagagtcatagacttgggctgtggaagaggaggctggtcatattactgtgcaggattgaaaaaagttacggaagtgcgaggatacacaaaaggcggcccaggacatgaagaaccagtacctatgtctacatatggatggaacatagtcaagctgatgagtggaaaggatgtgttttatctcccacctgaaaagtgtgacactctattgtgtgacattggagaatcttcaccaagcccaacagtggaagagagcagaaccataagagtcttgaaaatggttgaaccatggctaaaaaataaccagttttgcatcaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaatatggtatccagactgctactgaacagattcacaatgacatataggagacccaccatagagaaagatgtggatttaggagcggggacccgacatgtcaatgcggaaccagaaacacccaacatggatgtcattggggaaagaataagaagaatcaaggaggagcatagttcaacatggcactatgatgatgaaaatccttacaaaacgtgggcttaccatggatcttatgaagttaaggccacaggctcagcctcctccatgataaatggagtcgtgaaactccttacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacggaggagaaccaatgggacagcgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatatatcttgagagatatttccaagatacctggaggagccatgtatgctgatgacacagctgggtgggatacaagaataacagaagatgacctgcacaatgaggaaaaaatcacacagcaaatggaccctgaacacaggcagttagcaaacgctatatttaagctcacataccaaaacaaagtggtcaaagtgcaacgaccaactccaaagggcacggtaatggacatcatatctaggaaagaccaaagaggcagtggacaggtgggaacttatggtttgaatacattcaccaacatggaagcccagttgatcagacaaatggaaggagaaggtgtgttgtcgaagacagacctcgagaaccctcatctgctagagaagaaaatcacacaatggttggaaactaaaggagtggagaggttaaaaagaatggccatcagcggggatgattgcgtggtgaaaccaattgacgacaggttcgccaatgccctgcttgccctaaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattgatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaggaccaatggtgcggatcactcattggtctcacttccagagcaacctgggctcagaacatacttaccgcaatccaacaggtaagaagccttataggcaatgaagagtttctggactacatgccttctatgaagagattcaggaaggaggaggagtcagagggagccatttggtaa

SEQ ID NO: 1289 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaacatgctgagcatcatcaacagacggaaaaagacatcgctctgtctcatgatgatgttaccagcaacacttgctttccacttgacttcacgagatggagagccgcgcatgattgtggggaagaatgaaagaggaaaatccctacttttcaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgttggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactactatggctaagaacaagcccacgctggacatagagctccagaagaccgaggccacccaactggcaaccctaaggaaactatgcattgaggggaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacagtggtttttcgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagccacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggcaagcccacaatggcagactgatcacagctaacccagtggtgaccaagaaggaagagcctgtcaatattgaggcagaatctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtcctcttaacttggatagggttaaattcaaaaaacacttctatgtcattttcatgcattgtgataggaattatcacactctatctgggagccgtggtgcaagctgatatggggtgtgtcataaactggaaaggcaaagaactcaaatgtggaagtggaattttcgtcactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaactccgagagatgtacacccaactatgtgaccacaggctaatgtcggcagctgttaaagatgagagagccgtacacgccgacatgggctattggatagaaagccaaaagaatggtagttggaagctagaaaaggcatctctcatagaggtgaaaacctgcacatggccaaaatcacacactctctggagcaatggtgtgttagagagtgacatgatcatcccaaagagtctggctggtcctatctcgcaacacaactacaggcccggataccacacccaaacagcaggaccctggcacctaggaaaattggagctggacttcaactattgtgaaggaacaacagttgtcatcacagaaaattgtgggacaagaggcccatcactgaggacaacaacagtgtcaggaaaattgatacacgaatggtgttgccgctcgtgtacacttcctcccctgcgatatatgggagatgacggctgctggtatggcatggaaattagacccattaatgagaaagaagagaacatggtaaagtctttagtctcagcagggagtggaaaggtggataacttcacaatgggtgtcttgtgtcttgcaatcctctttgaagaggtaatgagaggaaaatttgggaaaaagcatatgattgcaggggttctcttcatgtttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatccagagaaaatttattattgggagttgggttggccatggcaacaacgttgcaactgccagaggacattgaacaaatggcgaatggaatagccctggggctcatggctcttaaattgataacacaatttgaaacataccaactatggacggcattagtctccctaacgtgttcaaatacaattttcacgttgactgttgcctggagaacagccaccttgatcttggccggaatttcgcttttgccagtgtgccagtcctcgagcatgaggaaaacagattggctcccaatgactgtggcagctatgggagttccacctctaccactttttatcttcagtttgaaagatacactcaaaaggagaagctggccactgaatgagggggtgatggccgttggacttgtgagcattctagcaagttctctccttaggaatgacgtacccatggctggaccattagtggctgggggcttgctgatagcgtgctacgttataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtacttttgaaaacagcactactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggggcagtgttgacatacaatggaaaaagactggaaccaaactgggctagtgtgaaaaaagatctgatttcatacggaggaggatggagactgagtgcacaatggaaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaaccataatggatctccatcccgggtcaggaaagacgcggaaataccttccagctatagttagagaggcaatcaaaagacgcttaaggactctaattttggcaccaactagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacaccccctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaacttcaaagcagacagagtgatcgacccaagaagatgtctcaagccagttattttgacagacggacccgagcgcgtgatcctggcgggaccaatgccagtcaccgtagcgagtgctgcgcagaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaacttatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtctcgtcaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgcctctgctggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccacgccgtatccagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagaaagcagaaccataagagtcttgaaaatggttgaaccatggctaaaaaataaccagttttgcattaaagtattgaacccttatatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacccaccatagagaaagatgtggatttaggagcgggracccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggtcagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacaaggcaagtgtggaagctgcgtttacaacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaacgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaaggatggccatcagcggggatgattgcgtggtgaaaccaattgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctcccagggagcaggatggagccttaaagaaactgcatgcctagggaaagcctacgcccaaatgtgggctctcatgtattttcacagaagagatcttagactagcatccaacgccatatgctcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgtggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 1290 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagagggagatctcaaacatgctgagcattatcaacagacggaaaaagacatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctccccatgttggcatgggactggacacacgcgcccaaacctggatgtcggctgaaggagcttggaggcaagccgagaaggtagagacatgggcccttaggcacccagggttcacaatactagccctatttcttgcccattatataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaactgactcaaggtgccccacccaaggggaagcgattctacctgaggagcaggaccagaactacgtgtgtaggcacacatacgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgttgaagccatcttacctgaatatggaacccttgggctagaatgctcaccacggacaggtttggatttcaatgagatgattttgttgacaatgaagaacaaagcatggatggttcatagacaatggttttttgacctacctctaccatggacatcaggggctacaacagaaacaccaacctggaataagaaagagcttcttgtgacattcaaaaatgcacacgcaaaaaaacaagaagtagtagtccttggatcgcaagaaggagcaatgcacacagcactgacaggagccacagagatccaaacctcaggaggcacaagtatttttgcggggcacttgaaatgcagactcaagatggataaattggaactcaaggggatgagctatgcaatgtgctcaaatgcctttgtgttgaagaaagaagtctctgaaacacaacatgggacaatactcattaaggtcgagtacaaaggggaagacgcaccttgcaaaattcctttctccacggaggatggacaagggaaagtccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgatcgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggcccttttcagtggagtctcctggataatgaaaattggaataggtgtccttttaacttggatagggttgaattcaaaaaacacttctatgtcattttcatgcattgtgataggaatcatcacactctatctgggagccgtggtgcaggctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgcggaatcaggtcgacaactagaatggagaacctcttgtggaagcaaatagccaatgaactaaactacatactatgggaaaacaacatcaaattaacggtagttgtgggtgatataattggggtcttagagcaagggaaaagaacactaacaccacaacccatggagctaaaatattcatggaaaacatggggaaaggcgaaagtagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaactccgagagatgtacacccaactatgtgaccacaggctaatgtcggcagccgttaaggatgagagagccgtacacgccgacatgggctattggatagaaagccaaaagaatggtagttggaagctagagaaggcatctctcatagaggtgaaaacctgtacatggccaaaatcacacactctctggagcaatggtgtgttggagagtgacatgattatcccaaagagtctggctggtcccatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaactacagtgtcagggaaattgatacacgaatggtgttgccgctcgtgcacacttcctcccctgcgatatatgggagaagacggctgctggtatggcatggaaattagacctattaatgagaaagaagagaacatggtaaagtctttagtctcagcagggagtggaaaggtggataacttcacaatgggtgtcttgtgtcttgcaatcctctttgaagaggtaatgagaggaaaattcgggaaaaagcacatgattgcaggggttctcttcatgtttgtgctccttctctcagggcaaataacatggagagacatggcgcgcacactcataatgattggatccaacgcctctgacagaatgggaatgggcgtcacttacctagcattgattgcaacattcaaaattcagccatttttggctttgggattcttcctgaggaaactgacatctagagaaaatttattattgggagttgggttggccatggcaacaacgttgcaactaccagaggacattgaacaaatggcgaatggaatagccttggggcttatggctcttaaattgataacacaatttgaaacataccaactatggacggcattagtctccctaacgtgttcaaacacaattttcacgttgactgtcgcctggagaacagccaccctgatcttggccggaatttcgcttttgccagtgtgccagtcttcgagcatgaggaaaacagattggctcccaatgactgtggcagctatgggagttccacctctaccactctttattttcagtttgaaagacacactcaaaaggagaagctggccactgaatgagggggtgatggccgttggacttgtgagcattctagcaagttctctccttaggaatgacgtacccatggctggaccattagtggctgggggcttgttgatagcgtgctacgtcataactggcacgtcagcagaccttactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagtcttccacactatgtggcacgtcacaagaggagcagtgttgacatacaatggaaaaagactggaaccaaactgggctagcgtgaaaaaagatctgatttcatacggaggcggatggagactgagtgcacaatggcgaaaaggagaagaggtgcaggttattgctgtagagcctgggaagaacccaaagaactttcaaactatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaatgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttagcaccaacaagggtggttgcagctgagatggaagaagcattgaaagggctcccaataaggtatcaaacaactgcaacaaaatctgaacacacagggaaagagattgttgatctaatgtgtcacgcaacgtttacaatgcgtttgctgtcaccagtcagagttccaaactacaacttgataataatggatgaggctcatttcacagacccagccagtatagcggctagagggtacatatcaactcgtgtaggaatgggagaagcagccgcaattttcatgacagccacacctcctggaacagctgatgcttttcctcagagcaacgctccaattcaagatgaagaaagagacataccagaacgctcatggaattcaggcaatgattggattactgactttgccggaaagactgtgtggtttgtccccagcatcaaagctggaaacgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggagaggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgctcgcacttactcagatcccttagcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacattcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctactaataccagaaccagaaaagcagagaactccccaagacaatcagcttgcatatgtcgtgataggcatacttacattggctgcgatagtagcagccaatgaaatgggattgttggaaaccacaaagagagatttggggatgtccaaagaaccaggtgttgtttcaccaaccagctatttggatgtggatttgcacccagcatcagcctggacattgtacgctgtggccacaacagtaataacaccaatgttgagacataccatagagaattctacagcaaatgtgtccctggcagctatagccaaccaggcagtggtcctgatgggtttagacaaaggatggccgatatcgaaaatggatttaggcgtgccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcgttttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgagactttgggagaaaagtggaaaaagaaattgaatcaactatcccggaaagagtttgacctctacaagaaatccggaatcactgaagtggatagaacagaagccaaagaagggttgaaaagaggagaaacaacacaccatgccgtatccagaggcagcgcgaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactttattgtgtgacattggagaatcttcaccaagcccaacagtggaagagagcagaaccataagagtcttgaaaatggttgaaccatggctaaaaaataaccagttttgcattaaagtattgaacccttacatgccaactgtaattgagcacctagaaagactacaaaggaagcatgggggaatgcttgtgagaaatccactctcacgaaactccacgcacgaaatgtactggatatctaatggcacaggcaacatcgtctcttcagtcaacatggtatccagactgctactgaacagattcaccatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacagggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattatacaatggttggaaaccaaaggagtagagaggttgaaaagaatggccatcagcggggatgattgcgtggtgaaaccaatcgacgataggttcgccaatgccctgcttgccctgaatgacatgggaaaagttaggaaggacataccccaatggcagccatcgaggggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcttagggaaagcctacgcccagatgtgggctctcatgtattttcacagaagagatcttagactggcatccaacgccatatgttcagcagtgccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagttccttgactacatgccttcgatgaagagattcaggaaggaggaggagtcagagggagccatttggtaa

SEQ ID NO: 1291 - DNA, 10173 bp, Dengue virus
atgaacaaccaacggaaaaagacgggaaaaccgtcaatcaatatgctgaaacgcgtgagaaaccgtgtgtcaactggatcacagctggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaagacatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacgatcacttacaaatgccccctcattactgaagtggagcctgaagacattgactgctggtgcaacctcacatcgacgtgggtgacctacggaacgtgcaaccaagctggagagcatagacgcgacaagagatcggtggcgttagctcctcatgttggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggctaagaacaagcccmcgctggacatagagctccagaagaccgaagccacccaactggcaaccctaaggaaactatgtattgaggggaaaatcaccaacgtgacaaccgactcaaggtgccccactcaaggggaagcgattctacctgaggagcaggaccagaactacgtgtgtaagcacayatacgtggacagaggctggggaaacggttgtggcttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggtttttcgacctacctytaccatggacatcaggggctacaacagaaacaccaacctggaataaraaagagcttcttgtgacattcaaaaatgcacacgcaaaaaaacaagaggtagtagtccttggatcgcaagagggagcaatgcacacagcactgacaggagccacagagatccaaacctcaggaggcacaagtatttttgcggggcacttgaaatgcagactcaagatggacaaattggaactcaaggggatgagctatgcaatgtgctcaaatgcctttgtgttgaaraaagaagtctctgaaacacaacatgggaccatactcattaaggtcgagtacaaaggggaaracscaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttaaattcaaaaaacacttctatgtcattttcatgcattgtgataggaatcatcacactctatctgggagccgtggtgcaagctgatatggggtgtgtcataaactggaaaggcaaagaactcaaatgtggaagtggaattttcgtcactaatgaggtccacacctggacagagcaatacaaatttcaggcagactcccccaaaagactggcgacagccattgcaggcgcctgggagaatggagtgtgcggaatcaggtcgacaaccagaatggagaacctcttgtggaagcraatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaacttcgagagatgtacacccaactatgtgaccacaggcttatgtcggcagctgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttagagagtgacatgatcatcccaaagagtctggctggtcctatctcgcaacacaactacaggcccggataccacactcaaacggcaggaccctggcacctaggaaaattggagctggacttcaactattgtgaaggaacaacagttgtcatcacagaaaactgtgggacaagaggcccatcactgaggacaacaacagtgtcagggaagttgatacacgaatggtgttgccgctcgtgtacacttcctcccctgcgatatatgggaraagacggctgctggtatggcatggaaattagacccattaatgaraaaraararaacatggtaaagtctttagtctcagcagggagtggaaaggtggataacttcacaatgggtgtcttgtgtcttgcaatcctctttgaagaggtaatgagaggaaaatttgggaaaaagcacatgattgcaggggttctcttcatgtttgtgctccttctctcagggcaaataacatggagagacatggcgcgcacactcataatgattggatccaacscctctgacagaatgggaatgggcgtcmcctacctagcattgattgcaacatttaaaattcagccwtttttggytttgggattcttcctgaggaaactgacatctagagaaaatttattattgggagttgggttggccatggcaacaacgttgcaactgccagaggacattgaacaaatggcgaatggaatagccttggggctcatggctyttaaattgataacacaatttgaaacataccaactatggacggcattagtctccctaacgtgttcaaatacaattttcacgttgactgttgcctggagaacasccmccctgatcttggccggaatttygcttttgccagtgtgccagtcctcgagcatgaggaaaacagattggctcccaatgactgtggcagctatgggagttccacctctaccmctttttatcttcagtttgaaagacacacttaaaaggagaagctggccactgaatgagggggtgatggccgttggacttgtgagcatcctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtacttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagayccaartgggggttggagtacaaaaagaaggagttttccatactatgtggcacgtcacaagaggggcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaaccataatggatctccatcccgggtcaggaaagacgcggaaataccttccagctatagttagagaggcaatcaagagacgcttaaggactytaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaatcttcatgacagccacaccccctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagatatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggaragggagagttggcaggaacccacaaaaagaaaatgaccaatacatattcacgggccagcccctcaacaatgatgaaraccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagagcacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagagccagaaaagcagagaactccccaagacaatcaactcgcatatgtcgtgataggcatacttacattggctgcaatagtagcagccaatgaaatgggattgttggaaaccacaaagagagatttagggatgtccaaagaaccaggtgttgtctcgccaaccagctacttggatgtggatttgcacccagcatcagcctggacattgtacgctgtggccacaacagtaataacaccaatgttgagacataccatagagaattctacagcaaatgtgtccctggcagctatagccaaccaagcagtggtcctgatgggtttagacaaaggatggccgatatcgaaaatggacttaggcgtgcctctgttggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgcgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactctgggagaaaagtggaaaaagaaattgaaccaattatcccggaaagagtttgacctctacaagaaatccggaatcactgaagtggatagaacagaagccaaagaagggttgaaaagaggagaaacaacacaccatgccgtatccagaggcagcgcaaaacttcaatggttcgtggagagaaatatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaaragagcagaaccataagagtcttgaaaatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcgggatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacaaggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttggcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaaracagacctcgagaaccctcatctgctagagaagaaaattacacaatggttggaaaccaaaggagtggagaggttaaaaagaatggctatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaaattggtagtcccctgcagaccccaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 1292 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagttgggggctattaaggtcctgagaggcttcaagaaggagatctcaaatatgctgagcattatcaacagacggaaaaagacatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacgatcacttacaaatgccccctcattactgaagtggagcctgaagacattgactgctggtgcaacctcacatcgacgtgggtgacctacggaacgtgcaaccaagctggagagcacagacgcgataagagatcggtggcgttagctcctcatgttggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatctatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaagccacccaactggcaaccctaagaaaactatgtattgaggggaaaatcaccaacgtgacaaccgactcaaggtgccccactcaaggggaagcgattctacctgaggagcaggaccagaactacgtgtgtaagcacacatacgtggacagaggctggggaaacggttgtggcttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggttagaatgctcaccacggacaggtttggatttcaatgaaatgattttgttgacaatgaagaacaaagcatggatggtacatagacaatggtttttcgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagccacagagatccaaacctcaggaggcacaagtatttttgcggggcacttgaaatgcagactcaagatggacaaattggaactcaaggggatgagctatgcaatgtgctcaaatgcctttgtgttgaaraaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccatttttagtggagtctcctggataatgaaaattggaataggtgtccttttaacttggatagggttaaattcaaaaaacacttctatgtcattttcatgcattgtgataggaatcatcacactctatctgggagccgtggtgcaagctgatatggggtgtgtcataaactggaaaggcaaagaactcaaatgtggaagtggaattttcgtcactaatgaggtccacacctggacagagcaatacaaattccaggcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaacttcgagagatgtacacccaactatgtgaccacaggcttatgtcggcagctgttaaggatgagagagccgtacacgccgacatgggctattggatagaaarccaaaagaatggtagttggaagctagaaaargcatctytcatagaggtaaaaacctgcacatggccaaaatcacacactctctggagcaatggtgtgttagagagtgacatgatcatcccaaagagtctggctggtcctatctcgcaacacaactacaggcccggataccacactcaaacggcaggaccttggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacmcttcctcccctgcgatatatgggaraaracggctgctggtatggcatggaaattaracccattaatgaraaaraararaacatggtaaagtytttagtctcagcagggagtggaaaggtggataacttcacaatgggtgtcttgtgtcttgcaatcctctttgaagaggtaatgagaggaaaatttgggaaaaagcacatgattgcaggggttctcttcatgtttgtgctccttctctcagggcaaataacatggagagacatggcgcgcacactcataatgattggatccmacgcctctgacagaatgggaatgggcgtcacttacctagcattgattgcaacatttgaaattcagccatttttggctttgggattcttcctgaggaaactgacatctagagaaaatttattattgggagttgggttggccatggcaacaacgttgcaactgccagaggacattgaacaaatggcgaatggaatagccttggggsttatggctyttaaattgataacacaatttgaaacataccaactatggacggcattagtctccctaacgtgttcaaatacaattttcacgttgactgttgcctggagaacavccmccctgatyttggccggaatttygcttttgccagtgtgccmgtcctcgagcatgaggaaaacagattggctcccaatgactgtggcagctatgggagttccmcctctaccmctttttatcttcagtttgaaagacacacttaaaaggagaagctggccactgaatgagggggtgatggccgttggacttgtgagcatcctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtacttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggggcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgcttgctgtcaccagtcagagttccaaactacaacttgataataatggatgaggctcatttcacagacccagccagtatagcggctagagggtacatatcaactcgtgtaggaatgggagaggcagccgcaatcttcatgacagccacaccccctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagatatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcscaaaggaragggagagttggcaggaacccacaaaaagaaaatgaccaatatatattcacgggccagcccctcaacaatgatgaagaccacgctcactggacagaagcaaaaatgctgctagacaacatcaacacaccagaaggaatcataccagytctctttraaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtaraaagtcgatcgcccttgatcttgtgacagaaataggaagagtgccttcacatttagcccacagaacgagaaacgctctggacaatctggtgatgttgcacacgtcagagcacggtgggagggcctacaggcatgcagtggaggaattaccagaaacaatggaaacactyttaytcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtctcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgcctctgttggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttttggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagagattgaatcaattatcccggaaagagtttgacctctacaagaaatccggaatcactgaagtggatagaacagaagccaaagaagggttgaaaagaggagaaataacacaccatgccgtatccagaggcagcgcaaaacttcaatggttcgtggagagaaatatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttatatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatacaggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcgggatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaaratgaaraattctggaaactcgtggacagagaacgtgaactccacaaacaaggcaagtgtggaagctgcgtttataacatgatgggcaararagaraaraaacttggagagtttggcaaagcaaaaggcagtaragccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatytaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttgaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 1293 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaagacatcgctctgtctcatgatgatgttaccagcaacacttgctttccacttgacttcacgagatggagagccgcgcatgattgtggggaagaatgaaagaggaaaatccctactctttaagacagcctctggaatcaacatgtgcacactcatagccatggatttgggagaaatgtgtgatgacacgatcacttacaaatgccccctcattactgaagtggagcctgaagacattgactgctggtgcaacctcacatcgacgtgggtgacctacggaacgtgcaaccaagttggagagcatagacgcgataagagatcggtggcattagctcctcatgttggcatgggactggacacacgcgcccaaacctggatgtcggctgaaggagcttggagacaagtcgagaaggtagagacatgggcctttaggcacccagggtttacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaagccacccaactggcaaccctaaggaaactatgcattgaggggaaaatcaccaacgtgacaactgactcaaggtgccccactcaaggggaagcgattctacctgaggagcaggaccagaactacgtgtgtaagcacacatacgtggacagaggctggggaaacggttgtggcttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaactgtcgaagccatcttacctgaatatggaacccttgggctagaatgctcaccacggacaggtttggatttcaatgaaatgattttgttgacaatgaagaacaaagcatggatggtacatagacaatggtttttcgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagccacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggattttggatcagtaggtggtgttttaaattcactagggaaaatggtgcaccaaatatttggaagtgcttacacagccctttttagtggagtctcctggataatgaaaattggaataggtgtccttttaacttggatagggttaaattcaaaaaacacttctatgtcattttcatgcattgtgataggaatcatcacactctatctgggagccgtggtgcaagctgatatggggtgtgtcataaactggaagggcaaagaactcaaatgtggaagtggaattttcgtcactaatgaggtccacacctggacagagcaatacaaatttcaggcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaacttcgagagatgtacacccaactatgtgaccacaggcttatgtcggcagctgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttagagagtgacatgatcatcccaaagagtctggctggtcctatctcgcaacacaactacaggcccggataccacactcaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaatcctctttgaagaggtaatgagaggaaaatttgggaaaaagcacatgattgcaggggttctcttcatgtttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaacgtgttcaaatacaattttcacgttgactgttgcctggagaacagccaccctgatcttggccggaatttcgcttttgccagtgtgccagtcctcgagcatgaggaaaacagattggctcccaatgactgtggcagctatgggagttccacctctaccactttttatcttcagtttgaaagacacacttaaaaggagaagctggccactgaatgagggggtgatggccgttggacttgtgagcatcctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaacttaatgatcacagttgatgatgatggaacaatgagaataaaagatgatgagactgagaacatcttaacagtacttttgaaaacagcattactaatagtgtcaggcatttttccatactccatacctgcaacacttttggtttggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggggcagtgttgacatataatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcactgaaagggctcccaataaggtatcaaacaactgcaacaaaatctgaacacacagggaaagagattgttgatctaatgtgtcacgcaacgttcacaatgcgtttgctgtcaccagtcagagttccaaattacaacttgataataatggatgaggctcatttcacagacccagccagtatagcggctagagggtacatatcaactcgtgtaggaatgggagaggcagccgcaatcttcatgacagccacaccccctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagatatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagagcacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggaatgttggaaaccacaaagagagatttggggatgtccaaagaaccaggtgttgtctcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgcctctgttggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaattactgaagtggatagaacagaagccaaagaagggttgagaagaggagaaataacacaccatgccgtatccagaggcagcgcaaaacttcaatggttcgtggagagaaatatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttatatgccaactgtgattgagcacctagaaagactacaaaggaaacatggaggaatgcttgtgagaaatccactctcacgaaactccacgcacgaaatgtactggatatctaatggcacaggcaacattgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtctttaaagagaaagtggacaccaggacacccaaacccatgccaggaacaagaaaggctatggagatcacagcgggatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacaaggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagacatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagtccagttgatcagacaaatggaaggagagggtgtgttgtcgaagacagacctcgagaaccctcatctgctagagaagaaaatcacacaatggttggaaaccaaaggagtggagaggttaaaaagaatggccatcagcggagatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcggcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 1294 - DNA, 10173 bp, Dengue virus
atgaacaaccaacgaaaaaagacgggaaaaccgtctatcaatatgctgaaacgcgtgagaaaccgtgtgtcaactggaacacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagtattatcaacaaaaggaaaaagacatcgctctgtctcatgatgatgttaccagcaacacttgctttccacttgacttcacgtgatggagagccgcgcatgattgtggcgaagaatgaaagagggaaatccctactttttaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacatatggaacgtgcaatcaagctggggagcatagacgcgacaagagatcagtggcgttagctccccatgtcggcatgggactggacacacgcacccaaacctggatgtcggctgaaggagcttggagaccagtcgagaaggtagagacatgggctcttaggcacccaggtttcaccatactagctctatttcttgctcattacataggcacttccctgacccagaaagtggttatttttatactactaatgctggtcactccatccatgacaatgagatgcgtgggagtgggaaacagagattttgtggaaggtctgtcgggagctacgtgggttgacgtggtgctcgagcacggtgggtgcgtgactaccatggctaagaacaagcctacgctggacatagagcttcagaagaccgaggccacccaactggcgaccctaaggaagttatgcattgagggaaaaattaccaacgtaacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgctgaagctatcttgcctgagtatggaacccttgtgttagaatgctcaccacggacaggtttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagttaaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctctggagcaatggtgtactagagagtgacatgatcatcccaaagagtctagctggtcctatttcacaacacaaccacaggcccgggtactacacccaaacggcaggaccttggcacttgggaaaattggagctggacttcaactattgtgaaggaacaacagtagtcatcacagaaaactgtgggacaagaggcccatcattgagaacaacaacagtgtcagggaagttgatacacgaatggtgttgccgctcgtgcacacttcctcccttgcgatacatgggagaggacggctgctggtatggcatggagattagacctatcaatgagaaagaagagaacatggtaaagtctttagtctcagcagggagtggaaaggtggacaactttacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggacgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcctatggctggaccactagtggccgggggcttgttgatagcgtgctatgtcataactggcacgtcagcagacctcaccgtagaaaaagcagcagatgtgacatgggaggaagaggctgagcaaacaggagtgtcccacaatttgatgatcacagttgatgatgatggaacaatgagaataaaggatgatgagactgagaacatccctacagtgctcttaaaaacagcattactaatagtttcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgggtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggcgagtccaggaagaccttcgtggaactcatgaggaggggtgacctcccagtttggctagcccataaagtagcatcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacagagaactccccaagacaaccaacttgcatatgtcgtgataggcatacttacactggctgcgatagtagcagccaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtgccgctactggcactgggctgctattcacaagtgaacccactgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggacctataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcccatgccagggacaagaaaggttatggagatcacggcggaatggctttggagaaccctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaacttgtgggacagagaacgtgaactccacaaattaggcaagtgtggaagctgcgtctacaacatgatgggcaagagggagaagaaacttggagagtttggcaaagcaaaaggcagtagagctatatggtacatgtggttgggagccaggtaccttgagttcgaagcactcggttttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggcagacctcgagaaccctcatctgctagagaagaaaatcaccccatggttggaacccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagatcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1295 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcattatcaacaaaaggaaaaagacatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaatcaagctggggagcacagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactggctcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaacctcaaatacactgtcatcatcacagtgcacacaggagaccaaccccaggtgggaaatgacacgcagggagtcacggttgagataacaccccaggcatcaaccgttgaagctgtcttgcttgaatatggaacccttgggctaaaatgctcaccacggacaggcttggatttcaatgaaatgattttattgacaatgaagaccaaagcctggatggtacataggcaatggttctttgacctacccctaccatggacatcaggagctacaacagagacaccaacttggaacaggaaagagcttcttgtaacattcaaaaatgcacatgcgaaaaagcaagaagtagttgtccttggatcacaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggctgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaaatctttagtctcagcagggagtggaaaagtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggatgtacccagccccccagaaacacagaaagcagaactggaagagggggtctataggatcaaacaacaaggcatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtaggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgaaatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcagaagaccagactgaatgattgggacttcctggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatacttacactggctgcgatagtagcagctaatgaaatgggattactggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggaactgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacattgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtccaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1296 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacagctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgtttgaggctactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgtattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcaacagccattgcaggtgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaatttccacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaaacctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataaccaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggcagatgtcccactccaatggatcgcgtcggccatagtcctagagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggtccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgtcgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagaaaagaaagttacacaatggttggaaacaaaaggagtggagaggttaaaaagaatggccatcagcggggatgattgcgtggtgaaaccaatcgatgacagattcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagaaggagccatttggtaa

SEQ ID NO: 1297 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaatgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacgcttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgccttaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgcgtgatcctggcgggaccaatgccagtcaccgtagcgagcgctgcacaaaggagagggagagtcggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 1298 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagccccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacagctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggctactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcaacagccattgcaggtgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataactttacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaatccagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaaacctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtctggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggcagatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgtcgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggttccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagaaaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatactcacggcaatccaacaggtgagaagccttataggcaatgaagagtttctggactacatgccttcaatgaagagattcaggaaggaggaggagtcagagggagccatttggtaa

SEQ ID NO: 1299 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagatttcgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcaccatcacagtgcacacaggagatcaacaccaggtgggaaatgaaacgcagggagtcacagctgagataacaccccaggcatcaaccgttgaagccattttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagataaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcgaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagaggtgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggacaacttcacaatgggtgtcttgtgtttggcaatcctctttgaagaggtgatgagaggaaaatttgggaaaaagcacatgatttcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccactagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtattgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaacagcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtcgcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgagaaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagccgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggacgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaacccttacctgctagagaagaaagttacacaatggttggaaacaaaaggagtggagaggttaaaaagaatggccatcagcggggatgactgcgtggtgaaaccaatcgatgacaggtttgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgtggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 1300 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcattatcaacaaaaggaaaaagacatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggttatttttgtactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacaccccaggcatcaaccgttgaagctgtcttgcctgagtatggaacccttggtctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtttccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagttcgatagggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaatcttcgttactaatgaggtccacacctggacagagcaatacaaatttcaagcagactcccctaaaagactggcgacagccattgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagcgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctctggagcaatggtgtactagagagtgacatgatcatcccaaagagtttagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggctggccatggcaacaacgctacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagaaggaaaggtagtgggactatatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggacgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcgagtgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcctttagcactcaaggaattcaaggattttgcagctggcaggaagtcaatcgcccttgatctcgtgacagaaataggaagagtgccttcacacttagcccacagaacgagaaacgccctggacaatttggtgatgctgcacacgtcagaacatggcggtagggcttacaggcatgcagtggaggaactaccagaaacaatggaaacactcctactcatgggactcatgatcttattaacaggtggagcaatgctcttcttgatatcaggtaaagggattggaaagacttcaataggactcatttgtgttattgtttccagtggcatgttatggatggctgatatcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggactgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttctgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtctagaggcagcgcaaaacttcaatggttcgtggagaggaacatggtcattcccgaaggaagagtcatagacttaggttgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcctaccatggatcctatgaagtcaaagccacaggctcagcctcctccatgataaatggagtcgtgaaactcctcacaaaaccatgggatgtggtccccatggtgacacagatggcaatgacagatacaactccatttgggcagcaaagagttttcaaagagaaagtggacaccaggacacccaggcccatgccagggacaagaaaggttatggagattacagcggaatggctttggagaaccttgggaaggaacaaaaaacccagattgtgcacaagggaagagttcacaaaaaaggtcagaaccaacgcggctatgggagctgttttcacagaggagaaccaatggaatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagctatgtatgctgatgacacagctggttgggacacaagaataacagaagatgacctgcacaatgaggaaaaaatcacacagcaaatggaccctgaacacagacaattagcgaacgccatattcaagctcacataccaaaacaaagtggtcaaagtccaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaagtccctttctgctcccaccattttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtaccagtccattgggtccctacgagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagcctcataggcgatgaagaatttctggactacatgccttcgatgaagagattcaggaaggaggaggagacagagggagccatttggtaa

SEQ ID NO: 1301 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcttatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttctgaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagagattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 1302 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaagggccaatgaaattggttatggcgttcatagctttcctcagatttctagccattccaccaacagcaggagtcttggctagatggggaaccttcaagaagtcaggggccattaaggtcctaaaaggcttcaagagggagatttcaaacatgctgagcattatcaacaaaaggaaaaagacatcgctctgtctcatgatgatgttaccagcaacacttgctttccacttgacttcacgcgatggagagccgcgcatgattgtgggaaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgtacccaaacctggatgtcggctgaaggagcttggagacaagtcgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtgggaaacagagattttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgactttacctgaggagcaggaccagaactacgtatgtaagcacacatacgtggatagaggttggggaaatggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaggagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatacttatcaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgattcacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccatttttggctttgggattcttcctgaggaaattgacatctagagaaaatttgctgttgggagttgggttggccatggcaacaacgttacaactgccagaggacattgaacaaatggcgaatggaattgctctggggctcatgactctgaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagttggccactgaatgagggagtgatggctgttgggcttgtgagcattctagctagttctctccttaggaatgatgtgcccatggctggaccactagtggccgggggcttgttgatagcgtgctatgtcataactggcacgtcagcagaccttactgtagaaaaagcagcaaatgtaacatgggaggaagaggctgagcaaacaggagtgtcccacaatttgatgatcacagttgatgatgatggaacaatgagaataaagaatgatgagactgagaacatcctaacagtgctcttaaaaacagcattactaatagtatcaggcatctttccatactccatacccgccacactgttggtctggcatacttggcaaaagcaaacccaaagatctggcgttctttgggacgtacctagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggagataggagcaattgcactagacttcaagcccggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaacccgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaggacagtgtggtttgtccctagcatcaaagccggaaatgacatagcaaactgcctgcggaaaaatggaaaaaaggttatccaacttagtaggaagacttttgatacagaatatcaaaagaccagactgaatgactgggacttcgtggtgacaacagacatttcagaaatgggagctaactttaaagcagatagagtgattgacccaagaagatgtctcaagccagttattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccacgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactcacactggctgcgatagtagcagctaatgaaatgggattgttggaaactacaaagagagatttaggaatgtctaaagaaccaggtgttgtttctccaaccagctatttagatgtagacttgcacccagcatcagcctggacgttgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtagatgggataatgacaatagacctagatcctgtaatatacgattcaaaattcgaaaagcaattaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcatccccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaagaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaatgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccaccagtggatgactacagaagacatgcttactgtctggaacagggtgtggatagaggacaatccatggatggaagacaaaactccagtcacaacttgggaagatgttccatacctagggaaaagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1303 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcactgctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacctctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatctaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggtcattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccagtgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 1304 - DNA, 10173 bp, Dengue virus
atgaacaaccaacgaaaaaagacgggaaaaccgtctatcaatatgctgaaacgcgtgagaaaccgtgtgtcaactggaacacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagtattatcaacaaaaggaaaaagacatcgctctgtctcatgatgatgttaccagcaacacttgctttccacttgacttcacgtgatggagagccgcgcatgattgtggcgaagaatgaaagagggaaatccctactttttaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtggcgctagctccccatgtcggcatgggactggacacacgcacccaaacctggatgtcggctgaaggagcttggagacaagtcgagaaggtagagacatgggctcttaggcacccaggtttcaccatactagctctatttcttgctcattacataggcacttccctgacccagaaagtggttatttttatactactaatgctggtcactccatccatgacaatgagatgcgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgttgaagctatcttgcctgagtatggaacccttgggttagaatgctcaccacggacaggtttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccacaggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagttgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacctcagcagacctcaccgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtttcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgggtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtaccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttctagtggcatgttatggatggctgatgtcccacttcaatggatcgcgtcggctatagtcctggaatttttcatgatggtgttgctcataccagaaccagaaaaacagagaactccccaagacaaccaactcgcatatgtcgtgataggcatacttacactggctgcgatagtagcagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggcccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctctatgataaatggagtcgtgaaactcctcacaaaaccatgggatgtggtgcccatggtgacacagatggcaatgacagatacaactccatttgggcagcaaagagttttcaaagagaaagtggacaccaggacacccaggcccatgccagggacaagaaaggttatggagatcacggcggaatggctttggagaaccctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggttttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1305 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaagaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaagtgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacacagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaatttttgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacatgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacggcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttactgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcattaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaagaaacaaaagacccagattatgtacgagagaggagttcataaaaaaggtcagaaccaacgcagctatgggcgccgttttcacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggaccctgaacacaggcggttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 1306 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacaggcggaaaaagacatcgctctgtctcatgatgatgttaccagcaacacttgctttccacttgacttcacgagatggagagccgcgcatgattgtggggaagaatgaaagaggaaaatccctgcttttcaagacagcctctggaatcaacatgtgcacactcatagccatggatttgggagaaatgtgtgatgacacggtcacttacaaatgccccctcattactgaagtggagcctgaggacattgactgctggtgcaacctcacatcgacgtgggtgacctacggaacgtgcaaccaagctggagagcatagacgcgataaaagatcggtggcgttagctccccatgttggcatgggactggacacacgcacccaaacctggatgtcggctgaaggagcttggagacaagtcgagaaggtagagacatgggcctttaggcacccagggttcacaatactagccctatttcttgcccattacatagggacttccttgacccagaaagtggtcattttcatactgctaatgttggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagaccgaggccacccaactagcaaccctaaggaaactatgcattgagggaaaaatcaccaacgtgacaaccgactcaaggtgccccacccaaggggaagcgattttacctgaggagcaggaccagaactacgtgtgtaagcacacatacgtggacagaggctggggaaacggttgtggcttgtttggcaagggaagcttggtaacatgcgcgaaatttcaatgtttggaatcaatagagggaaaagtggtgcagcatgagaacctcaaatacaccgtcatcatcacggtgcacacaggagaccaacaccaggtgggaaatgaaacgcagggagtcacggctgagataacaccccaggcatcaaccgtcgaagccgtcttacctgaatatggaacccttgggctagaatgctcaccacggacaggtttggactttaatgaaatgattttgttgacaatgaagaacaaagcatggatggtacacagacaatggttttttgacctacctctaccatggacatcaggggctacaacagaaacaccaacctggaataagaaagagcttcttgtgacattcaaaaacgcacacgcaaaaaaacaagaagtagtggtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgctcaaatgcctttgtgttgaagaaagaagtctctgaaacacagcatggaacaatactcataaaggtcgagtacaaaggggaagatgcaccctgcaagattcctttctccacggaggatggacaagggaaagcccacaatggcagactgatcacagccaacccagtggtgaccaagaaggaagagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcattggggaaaatggtgcaccaaatatttggaagcgcttacacggccctttttagtggagtctcctggataatgaaaattggaataggtgtccttttaacttggatagggttgaattcaaaaaacacttctatgtcattttcatgcattgtgattggaatcatcacactctatctgggagctgtggtgcaagctgacatggggtgtgtcataaactggaaaggcaaagaacttaaatgtggaagtggaattttcgttactaatgaggtccacacctggacagagcaatacaaatttcaagcagactccccaaaaagactggcgacagccattgcaggcgcctgggagaatggagtgtgtggaatcaggtcgacaaccagaatggagaacctcttgtggaagcaaatagccaatgaactaaactacatattatgggaaaacaacatcaaattaacggtagttgtgggtgatataactgggatcttagagcaagggaaaagaacactaacaccacaacccatggagctaaaatattcatggaaaacatggggaaaggcgaaaatagtgacagctgaaacacaaaattcttccttcataatagatgggcccaacacaccagagtgtccaagtgcctcgagagcatggaatgtgtgggaggtggaagattacgggttcggagttttcacaaccaatatatggctgaaactccgagagatgtacacccaactgtgtgaccacaggctaatgtcggcagccgttaaggatgagagagccgtacacgccgacatgggctattggatagaaagccaaaagaatggaagttggaagctagaaaaggcatctctcatagaggtgaaaacctgcacatggccaaagtcacacactctctggagcaatggtgtgttggagagtgatatgatcatcccaaagagtctggctggtcctatctcgcaacacaactacaggcccggataccacacccaaacggcaggaccctggcacctaggaaaattggagctggactttaactattgtgagggaacaacagttgtcatcacagaaaattgtgggacaagaggcccatcactgaggacaacaacagtgtcagggaaattgatacacgaatggtgttgccgctcgtgcacacttcctcctctgcgatacatgggagaagacggctgctggtatggcatggaaattagacccattaatgagaaagaagagaatatggtaaagtctttagtctcagcagggagtggaaaggtggacaacttcacaatgggtgtcttatgtttggcaatcctctttgaagaggtaatgagaggaaaattcggaaaaaagcacatgattgcaggggttctcttcacatttgtgctccttctctctgggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttgcaactgccagaggacattgaacaaatggcgaatggaatagccttggggctcatggctcttaaattgataacacaattcgaaacataccaactgtggacggcattagcctccctaatgtgttcaaacacaattttcacgttgactgttgcctggagaacagccaccctgattttggccggaatttcgcttttgccagtgtgccagtcttcgagcatgaggaaaacagattggctaccaatgactgtggcagctatgggagttccacctctaccactttttatcttcagtttgaaagacacactcaaaaggagaagctggccactgaatgagggggtgatggccgttggacttgtgagcattttggcaagctctctccttaggaatgacgtacccatggctggaccattagtggctgggggcttgctgatagcgtgctacgtcataactggcacgtcagcagaccttactgtagaaaaagcagcagatgtgacatgggaggaagaggctgagcaaacaggagtgtcccacaatctaatgatcacagttgatgatgatggaacaatgagaataaaagatgatgagactgagaacatcttaacagtgcttttgaaaacagcattactaatagtgtcaggcatttttccatactccatacccgcaacactgttggtctggcatacttggcaaaagcaaacccaaagatccggcgtcctatgggacgtacctagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacgacaggggagataggagcgattgcactggacttcaagcctggaacttcaggatctcccatcataaacagagagggaaaggtagtgggactgtacggcaatggagtggtcacaaagagtggtggctatgtcagtggaatagctcaaacaaacgcagaaccagacggaccgacaccagagttggaagaagagatgttcaaaaagcgaaatttaaccataatggatctccatcccgggtcaggaaagacgcggaaataccttccagccatagttagagaggcaatcaagagacgcttaaggaccctaattttggcaccaacaagggtggttgcagctgagatggaagaagcattgaaagggctcccaataaggtatcaaacaactgcaacaaaatccgaacacacagggaaagagattgttgatctaatgtgtcatgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacaccccctggaacagctgatgcctttcctcagagcaacgctccaattcaagatgaagaaagagacatcccagaacgctcatggaattcaggcaatgattggattaccgactttgccgggaagactgtgtggtttgtccccagcatcaaagctggaaatgacatagcaaactgcttgcgaaaaaatggaaaaaaggtcattcaacttagtaggaaaacttttgacacagaatatcaaaagactaaactaaatgattgggactttgtggtgacaacagacatttcggaaatgggagccaatttcaaagcagacagagtgatcgacccaagaagatgtctcaagccagtcattttgacagacggacccgagcgtgtgatcctggcaggaccaatgccagtcaccgtggcgagtgctgcacaaaggagagggagagttggcaggaacccacaaaaagaaaatgaccaatacatattcacgggccagcccctcaacaatgatgaagaccacgctcactggacagaagcaaaaatgctgctagacaacattaacacaccagaagggatcataccagctctctttgaaccagaaagggagaagtcagccgccatagacggcgaataccgcctgaaaggtgagtcccggaagactttcgtggaactcatgaggaggggtgacctcccagtttggctagcccataaagtagcatcagaaggaatcaaatacacagatagaaaatggtgttttgatggagagcgcaacaatcaaattttagaggagaatatggatgtggaaatttggacaaaggaaggagaaaagaaaaaattgaggcctaggtggcttgacgcccgcacttattcagatcccttagcgctcaaggaattcaaggactttgcggctggtagaaagtcgatcgcctttgatcttgtaacagaaataggaagagtgccttcacatttagcccacagaacgagaaatgctctggacaatttggtaatgttgcacacgtcagaacacggtgggagggcctacaggcatgcagtggaggaattaccagaaacaatggaaacactcttactcctgggactcatgatcctgttaacaggtggggcaatgcttttcttgatatcaggcaaagggattggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagataatcaactcgcatatgtcgtgataggcatacttacattggctgcaatagtagcagccaatgaaatgggattgttggaaaccacaaagagagatttggggatgtccaaagaaccaggtgttgtttctccaaccagctatttggatgtggatttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggatttaggcgtaccactactggcactgggttgctattcacaagtgaacccactaactctcacagcggcagtactcctgctagtcacgcattatgccattataggtccaggattgcaggcaaaagccactcgtgaagctcaaaaaaggacggctgctggaataatgaagaacccaacggtggatgggataatgacaatagacctagatcctgtaatatacgattcaaaatttgaaaaacaactaggacaagttatgctcctggttctgtgtgcagttcaactcttgttaatgagaacatcatgggcattttgtgaagctctaaccctagccacaggaccaataacaacactctgggaaggatcaccagggaagttctggaacactacgatagctgtttccatggcgaacatctttagagggagctatttagcaggagctgggctcgctttttctatcatgaaatcagttggaacaggaaagagaggaacagggtcacaaggtgaaactttgggagaaaagtggaaaaagaaattgaatcaattgtcccggaaagagtttgacctttacaagaaatccggaatcactgaagtggatagaacagaagctaaagaagggttgaaaagaggagaaataacacaccatgccgtatccagaggcagcgcaaaacttcaatggttcgtggagagaaacatggtcatccctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctaatgagtggaaaggatgtgttttatcttccacctgaaaagtgtgacactctattgtgtgacattggagagtcttcaccaagcccaacagtggaagagagcagaaccataagagtcttgaaaatggttgaaccatggctaaaaaacaaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactactactgaacagattcacaatgacatataggagacccaccatagagaaagatgtggatttaggagcggggacccgacatgtcaatgcggaaccagaaacacctaacatggatgtcattggggaaagaataaggaggattaaggaggagcatagttcaacatggcactatgatgatgaaaatccttacaaaacgtgggcttaccatggatcttatgaagttaaggccacaggttcagcctcctccatgataaatggagtcgtaaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggtcatggagatcacagcagaatggctctggagaaccctgggaaggaataaaagacccagattatgcacgagagaggagttcacaaaaaaggtcagaaccaacgcagctatgggcgccgtattcacagaggagaaccaatgggacagtgccagagctgccgttgaagatgaagaattctggaaactcgtggacagagaacgtgagctccacaaactgggcaagtgtggaagctgcgtttataacatgatgggcaagagagagaagaaacttggagagtttggcaaagcaaaaggcagtagagccatatggtacatgtggctgggagccaggtaccttgagttcgaggcactcggattcttaaatgaagaccattggttctcgcgtgaaaactcttacagtggagtagaaggggaaggactgcataagctgggatacatcttgagagacatttccaagataccaggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgattagacaaatggaaggagaaggtgtgttgtcgaagacagacctcgagaaccctcatctgctagagaagagaattacacaatggttggaaaccaaaggagtggagaggttaaaaagaatggccatcagcggggacgattgcgtggtgaaaccaatcgatgacaggttcgccaatgccctgcttgccctgaatgacatgggaaaagttaggaaggacatacctcaatggcaaccatcgaagggatggcatgattggcaacaggtccctttctgctcccaccactttcatgaattgattatgaaagatggaagaaagttggtagtcccctgcagacctcaggatgaattaatagggagagcgagaatctctcaaggagcaggatggagccttaaagaaactgcatgcctagggaaagcctacgcccaaatgtgggctctcatgtattttcacagaagagatcttagactagcctccaacgccatatgttcagcagtaccagtccattgggtccccacaagcagaacgacttggtccatccatgctcaccatcagtggatgactacagaagatatgcttactgtttggaacagggtgtggatagaggacaatccatggatggaagacaaaactccagttacaacttgggaagatgttccatatctagggaagagagaagaccaatggtgcggatcactcattggtctcacttccagagcaacctgggcccagaacatacttaccgcaatccaacaggtaaggagccttataggcaatgaagagtttctggactacatgccttcgatgaagagattcaggaaggaggaggagtcagagggagccatttggtaa

SEQ ID NO: 1307 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccttaaggaaactatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagattcaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggattttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgccgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaattgggagagctagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 1308 - DNA, 10173 bp, Dengue virus
atgaacaaccaacgaaaaaagacgggaaaaccgtctatcaatatgctgaaacgcgtgagaaaccgtgtgtcaactggaacacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagtattatcaacaaaaggaaaaagacatcgctctgtctcatgatgatgttaccagcaacacttgcttttcacttgacttcacgtgatggagagccgcgcatgattgtggcgaagaatgaaagagggaaatccctactttttaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgcacccaaacctggatgtcggctgaaggagcttggagacaagtcgagaaggtagagacatgggctcttaggcacccaggtttcaccatactagctctatttcttgctcattacataggcacttccctgacccagaaagtggttatttttatactactaatgctggtcactccatccatgacaatgagatgcgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgttgaagctatcttgcctgagtatggaacccttgggttagaatgctcaccacggacaggtttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaacttaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacattaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtatgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagttgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagctgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaagaggagctggccactgaatgagggagtgatggctgttgggcttgtgagcattctggctagttctctccttaggaatgatgtgcccatggctggaccactagtggccgggggcttgttgatagcgtgctatgtcataactggcacgtcagcagacctcaccgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtttcaggcatctttccatactccatacccgccacactgttggtctggcatacttggcaaaagcaaacccaaagatctggcgttctatgggacgtacccagccccccagaaacacagaaagcagaactggaagagggggtctataggattaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaacctaaccataatggatcttcatcctgggtcaggaaagacgcggaaatatcttccagccatcgtcagagaagcaatcaagagacgcttaagaactttaattttggcaccaacaagagtggttgcagctgagatggaagaagcactgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgggtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacagagaactccccaagacaaccaactcgcatatgtcgtgataggcatacttacactggctgcgatagtagcagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtgccgctactggcactgggctgctattcacaagtgaacccactgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcccatgccagggacaagaaaggttatggagatcacggcggaatggctttggagaaccctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggttttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1309 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacaggcggaaaaagacatcgctctgtctcatgatgatgttaccagcaacacttgctttccacttgacttcacgagatggagagccgcgcatgattgtggggaagaatgaaagaggaaaatccctgcttttcaagacagcctctggaatcaacatgtgcacactcatagccatggatttgggagaaatgtgtgatgacacggtcacttacaaatgccccctcattactgaagtggagcctgaggacattgactgctggtgcaacctcacatcgacgtgggtgacctacggaacgtgcaaccaagctggagagcatagacgcgataaaagatcggtggcgttagctccccatgttggcatgggactggacacacgcacccaaacctggatgtcggctgaaggagcttggagacaagtcgagaaggtagagacatgggcctttaggcacccagggttcacaatactagccctatttcttgcccattacatagggacttccttgacccagaaagtggtcattttcatactgttaatgttggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagaccgaggccacccaactagcaaccctaaggaaactatgcattgagggaaaaatcaccaacgtgacaaccgactcaaggtgccccacccaaggggaagcgattttacctgaggagcaggaccagaactacgtgtgtaagcacacatacgtggacagaggctggggaaacggttgtggcttgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccgtcttacctgaatatggaacccttgggctagaatgctcaccacggacaggtttggactttaatgaaatgattttgttgacaatgaagaacaaagcatggatggtacacagacaatggttttttgacctacctctaccatggacatcaggggctacaacagaaacaccaacctggaataagaaagagcttcttgtgacattcaaaaacgcacacgcaaaaaaacaagaagtagtggtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgctcaaatgcctttgtgttgaagaaagaagtctctgaaacacagcatggaacaatactcataaaggtcgagtacaaaggggaagatgcaccttgcaagattcctttctccacggaggatggacaagggaaagcccacaatggcagactgatcacagccaacccagtggtgaccaagaaggaggagcctgtcaatattgaggcagaacccccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcattggggaaaatggtgcaccaaatatttggaagcgcttacacggccctttttagtggagtctcctggataatgaaaattggaataggtgtccttttaacttggatagggttgaattcaaaaaacacttctatgtcattttcatgcattgtgattggaatcatcacactctatctgggagctgtggtgcaagctgacatggggtgtgtcataaactggaaaggcaaagaacttaaatgtggaagtggaattttcgttactaatgaggtccacacctggacagagcaatacaaatttcaagcagactccccaaaaagactggcgacagccattgcaggcgcctgggagaatggagtgtgtggaatcaggtcgacaaccagaatggagaacctcttgtggaagcaaatagccaatgaactaaactacatattatgggaaaacaacattaaattaacggtagttgtgggtgatataattggggtcttagagcaagggaaaagaacactaacaccacaacccatggagctaaaatattcatggaaaacatggggaaaggcgaaaatagtgacagctgaaacacaaaattcttccttcataatagatgggcccaacacaccagagtgtccaagtgcctcgagagcatggaatgtgtgggaggtggaagattacgggttcggagttttcacaaccaatatatggctgaaactccgagagatgtacacccaactatgtgaccacaggctaatgtcggcagccgttaaggatgagagagccgtacacgccgacatgggctattggatagaaagccaaaagaatggaagttggaagctagaaaaggcatctctcatagaggtgaaaacctgcacatggccaaagtcacacactctctggagcaatggtgtgttggagagtgatatgatcatcccaaagagtctagctggtcctatctcgcaacacaactacaggcccggataccacacccaaacggcaggaccctggcacctaggaaaattggagctggactttaactattgtgagggaacaacagttgtcatcacagaaaattgtgggacaagaggcccatcactgaggacaacaacagtgtcagggaaattgatacacgaatggtgttgccgctcgtgcacacttcctcctctgcgatacatgggagaagacggctgctggtatggcatggaaattagacccattaatgagaaagaagagaatatggtaaagtctttagtctcagcagggagtggaaaggtggacaacttcacaatgggtgtcttgtgtttggcaatcctctttgaagaggtaatgagaggaaaattcggaaaaaagcacatgattgcaggggttctcttcacatttgtgctccttctctctgggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttgcaactgccagaggacattgaacaaatggcgaatggaatagccttggggctcatggctcttaaattgataacacaattcgaaacataccaactgtggacggcattagcctccctaatgtgttcaaacacaattttcacgttgactgttgcctggagaacagccaccctgattttggccggaatttcgcttttgccagtgtgccagtcttcgagcatgaggaaaacagattggctgccaatgactgtggcagctatgggagttccacctctaccactttttatcttcagtttgaaagacacactcaaaaggagaagctggccactgaatgagggggtgatggccgttggacttgtgagcattttggcaagctctctccttaggaatgacgtacccatggctggaccattagtggctgggggcttgctgatagcgtgctacgtcataactggcacgtcagcagaccttactgtagaaaaagcagcagatgtgacatgggaggaagaggctgagcaaacaggagtgtcccacaatctaatgatcacagttgatgatgatggaacaatgagaataaaagatgatgagactgagaacatcttaacagtgcttttgaaaacagcattactaatagtgtcaggcatttttccatactccatacccgcaacactgttggtctggcatacttggcaaaagcaaacccaaagatccggcgtcctatgggacgtacctagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacgacaggggagataggagcgattgcactggacttcaagcctggaacatcaggatctcccatcataaacagagagggaaaggtagtgggactgtatggcaatggagtggtcacaaagagtggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagccatagttagagaggcaatcaagagacgcttaaggaccctaattttggcaccaacaagggtggttgcagctgagatggaagaagcattgaaagggctcccaataaggtatcaaacaactgcaacaaaatccgaacacacagggaaagagattgttgatctaatgtgtcatgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacaccccctggaacagctgatgcctttcctcagagcaacgctccaattcaagatgaagaaagagacatcccagaacgctcatggaattcaggcaatgattggattaccgactttgccgggaagactgtgtggtttgtccccagcatcaaagctggaaatgacatagcaaactgcttgcgaaaaaatggaaaaaaggtcattcaacttagtaggaaaacttttgacacagaatatcaaaagactaaactaaatgattgggactttgtggtgacaacagacatttcggaaatgggagccaatttcaaagcagacagagtgatcgacccaagaagatgtctcaagccagtcattttgacagacggacccgagcgtgtgatcctggcaggaccaatgccagtcaccgtagcgagtgctgcacaaaggagagggagagttggcaggaacccacaaaaagaaaatgaccaatacatattcacgggccagccccttaacaatgatgaagaccacgctcactggacagaagcaaaaatgctgctagacaacattaacacaccagaagggatcataccagctctctttgaaccagaaagggagaagtcagccgccatagacggcgaataccgcctgaaaggtgagtcccggaagactttcgtggaactcatgaggaggggtgacctcccagtttggctagcccataaagtagcatcagaaggaatcaaatacacagatagaaaatggtgttttgatggagagcgcaacaatcaaattttagaggagaatatggatgtggaaatttggacaaaggaaggagaaaagaaaaaattgaggcctaggtggcttgacgcccgcacttattcagatcccttagcgctcaaggaattcaaggactttgcggctggtagaaagtcgatcgcctttgatcttgtaacagaaataggaagagtgccttcacatttagcccacagaacgagaaatgctctggacaatttggtaatgttgcacacgtcagaacacggtgggagggcctacaggcatgcagtggaggaattaccagaaacaatggaaacactcttactcctgggactcatgatcctgttaacaggtggggcaatgcttttcttgatatcaggcaaagggattggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagataatcaactcgcatatgtcgtgataggcatacttacattggctgcaatagtagcagccaatgaaatgggattgttggaaaccacaaagagagatttggggatgtccaaagaaccaggtgttgtttctccaaccagctatttggatgtggatttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggatttaggcgtaccactactggcactgggttgctattcacaagtgaacccactaactctcacagcggcagtactcctgctagtcacgcattatgccattataggtccaggattgcaggcaaaagccactcgtgaagctcaaaaaaggacggctgctggaataatgaagaacccaacggtggatgggataatgacaatagacctagatcctgtaatatacgattcaaaatttgaaaaacaactaggacaagttatgctcctggttctgtgtgcagttcaactcttgttaatgagaacatcatgggcattttgtgaagctctaaccctagccacaggaccaataacaacactctgggaaggatcaccagggaagttctggaacactacgatagctgtttccatggcgaacatctttagagggagctatttagcaggagctgggctcgctttttctatcatgaaatcagttggaacaggaaagagaggaacagggtcacaaggtgaaactttgggagaaaagtggaaaaagaaattgaatcaattgtcccggaaagagtttgacctttacaagaaatccggaatcactgaagtggatagaacagaagctaaagaagggttgaaaagaggagaaataacacaccatgccgtatccagaggcagcgcaaaacttcaatggttcgtggagagaaacatggtcatccctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctaatgagtggaaaggatgtgttttatcttccacctgaaaagtgtgacactctattgtgtgacattggagagtcttcaccaagcccaacagtggaagagagcagaaccataagagtcttgaaaatggttgaaccatggctaaaaaacaaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactactactgaacagattcacaatgacatataggagacccaccatagagaaagatgtggatttaggagcggggacccgacatgtcaatgcggaaccagaaacacctaacatggatgtcattggggaaagaataaggaggattaaggaggagcatagttcaacatggcactatgatgatgaaaatccttacaaaacgtgggcttaccatggatcttatgaagttaaggccacaggttcagcctcctccatgataaatggagtcgtaaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggtcatggagatcacagcagaatggctctggagaaccctgggaaggaataaaagacccagattatgcacgagagaggagttcacaaaaaaggtcagaaccaacgcagctatgggcgccgtattcacagaggagaaccaatgggacagtgccagagctgccgttgaagatgaagaattctggaaactcgtggacagagaacgtgagctccacaaactgggcaagtgtggaagctgcgtttataacatgatgggcaagagagagaagaaacttggagagtttggcaaagcaaaaggcagtagagccatatggtacatgtggctgggagccaggtaccttgagttcgaggcactcggattcttaaatgaagaccattggttctcgcgtgaaaactcttacagtggagtagaaggggaaggactgcataagctgggatacatcttgagagacatttccaagataccaggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgattagacaaatggaaggagaaggtgtgttgtcgaagacagacctcgagaaccctcatctgctagagaagagaattacacaatggttggaaaccaaaggagtggagaggttaaaaagaatggccatcagcggggacgattgcgtggtgaaaccaatcgatgacaggttcgccaatgccctgcttgccctgaatgacatgggaaaagttaggaaggacatacctcaatggcaaccatcgaagggatggcatgattggcaacaggtccctttctgctcccaccactttcatgaattgattatgaaagatggaagaaagttggtagtcccctgcagacctcaggatgaattaatagggagagcgagaatctctcaaggagcaggatggagccttaaagaaactgcatgcctagggaaagcctacgcccaaatgtgggctctcatgtattttcacagaagagatcttagactagcctccaacgccatatgttcagcagtaccagtccattgggtccccacaagcagaacgacttggtccatccatgctcaccatcagtggatgactacagaagatatgcttactgtttggaacagggtgtggatagaggacaatccatggatggaagacaaaactccagttacaacttgggaagatgttccatatctagggaagagagaagaccaatggtgcggatcactcattggtctcacttccagagcaacctgggcccagaacatacttaccgcaatccaacaagtaagaagccttataggcaatgaagagtttctggactacatgccttcgatgaagagattcaggaaggaggaggagtcagagggagccatttggtaa

SEQ ID NO: 1310 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccatcccaccaacagcaggagtcttggctagatggggaaccttcaagaagtcaggggctattaaggtcctaaaaggcttcaagaaggagatttcaaacatgctgagcattatcaacaaaaggaaaaagacatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgcacccaaacctggatgtcggctgaaggagcttggagacaagtcgagaaggtagagacatgggctcttaggcacccagggttcaccatactagctctatttcttgcccattacataggcacttccctgacccagaaagtggttatttttatactactaatgctggtcactccatccatgacaatgagatgcgtgggagtaggaaacagagattttgtggaaggtctgtcgggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcattacagtgcacacaggagaccaacaccaggtgggaaatgacacgcagggagtcacggttgagataacaccccaggcatcaaccgttgaagctatcttgcctgaatatggaacccttgggctagaatgctcaccacggacaggtttggatttcaatgaaatgattttattgacaatgaagaacaaagcatggatggtacataggcaatggttctttgacctacccctaccatggacatcaggagctacaacagagacaccaacttggaacaggaaagagcttcttgtgacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgcgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacaacccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaatatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagttgatacacgaatggtgttgccgctcgtgcacacttcctcccttgcgatacatgggagaggacggctgctggtatggcatggaaattagacctatcaatgagaaagaagagaacatggtaaagtctttagtctcagcagggagcggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagggatatggcacacacactcataatgattgggtccaacgcttctgacaggatgggaatgggcgttacctacctagctttaattgcaacattcaaaattcagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacataccagttgtggacagcattagtctccctaacgtgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacactcaaaaggaggagctggccactgaatgagggggtgatggctgttgggcttgtgagcattctagctagttctctccttaggaatgatgtgcccatggctggaccactagtggccgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtagttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccattttacagatccagccagtatagcggctagagggtacatatcaactcgtgtaggaatgggagaggcagctgcaattttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcgaaaaaatggaaaaaaggtcatccaacttagtaggaagacttttgatacagaatatcaaaagaccaaactgaatgattgggacttcgtggtgacaacagacatttcagaaatgggagctaactttaaagcagatagagtgatcgacccaagaagatgtctcaagccagtgattttgacagatggacccgagcgggtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggattataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaagggatcaaatacacagatagaaaatggtgctttgatggagaacgtaataatcaaattttagaggagaacatggatgtggaaatctggacaaaggaaggagaaagaaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgcttccagtggcatgttatggatggccgatgtcccacttcaatggatcgcgtcggctatagtcctggaatttttcatgatggtgttgctcataccagaaccagaaaaacagagaactccccaagacaaccaactcgcatatgtcgtgataggcatactcacactggctgcgatagtagcagccaatgaaatgggactattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactgggctgctattcacaagtgaacccactgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggttatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagttaatgagtggaaaggatgtgttttatcttccacctgaaaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccaactgtgattgagcacctagaaagactacaaagaagatatggaggaatgcttgtgagaaacccactctcacgaaactccacgcatgaaatgtactggatatccaatggtaccggcaacatcgtctcttcagtcaacatggtatccagattgctactgaacagatttacaatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgagaactcttacagtggagtagaaggagaaggactgcacaagctgggatacattttaagagatatttccaagatacctggaggagctatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtagggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaagggttggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagagtttctggactacatgccttcgatgaagagattcaggaaggaggaggagtcagagggagccatttggtaa

SEQ ID NO: 1311 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattactgaacggccaaggaccaatgaaattggttatggcgttcatagctttcctcagatttctagccattccaccaacagcaggagttttggctagatggggaaccttcaagaagtcaggggctattaaggtcctaaaaggcttcaagaaggagatttcaaacatgctgagcattatcaacaaaaggaaaaagacatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgcacccaaacctggatgtcggctgaaggagcttggagacaagtcgagaaggtagagacatgggctcttaggcacccagggttcaccatactagctctatttcttgcccattacataggcacttccctgacccagaaagtggttatttttatactactaatgctggtcactccatccatgacaatgagatgcgtgggagtaggaaacagagattttgtggaaggtctgtcgggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggctggggaaacggttgtggtttgtttggaaaaggaagcttggtgacatgcgcgaaatttcaatgtctagaatcaatagagggaaaagtggtgcaacatgagaacctcaaatacactgtcatcattacagtgcacacaggagaccaacaccaggtgggaaatgacacgcagggagtcacggctgagataacaccccaggcatcaaccgttgaagccatcttgcctgaatatggaacccttgggctagaatgctcaccacggacaggtttggatttcaatgaaatgattttattgacaatgaaaaacaaagcatggatggtacataggcaatggttctttgacctacccctaccatggacatcaggagctacaacagagacaccaacttggaacaggaaagagcttcttgtgacattcaaaaatgcacatgcaaaaaagcaagaagtagttgtccttggatcgcaagagggagcaatgcacacagcgctgacaggagctacagagatccaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgattggaattggagacaaagccttgaaaattaactggtacaagaagggaagctcgattgggaagatgttcgaggccactgccagaggtgcaaggcgcatggccatcttgggagacacagcctgggactttggatcagtgggtggtgttctaaattcattagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgcgataggaattatcacactctatctgggagccgtggtacaagctgacatggggtgtgtcataaactggaaaggaaaagaactcaaatgtggaagtggaatttttgtcactaatgaggtccacacctggacagagcaatacaaatttcaagcagactcccctaaaagactggcgacagccattgcaggcgcttgggaaaatggagtctgtggaatcaggtcaacaaccagaatggagaatctattgtggaagcaaatagccaatgaactgaactacatattatgggaaaacaacattaaattaacggtagttgtgggcgacataattggggtcttagagcaagggaaaagaacactaacaccacaacccatggagctaaaatattcatggaaaacatggggaaaggcaaaaatagtgacagctgaaacacaaaattcctcttttataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccctcatagaggtgaaaacctgtacttggccaaaatcacacactctttggagcaatggcgtactagagagtgacatgatcatcccaaagagtctagctggtcctatttcgcaacacaaccataggcccgggtaccacacccaaacggcaggaacctggcacttgggaaaattggagctggatttcaactattgtgaaggaacaacagtagtcatcacagaaaactgtgggacaagaggcccatcattgagaacaacaacagtgtcagggaagttgatacacgaatggtgttgtcgctcgtgcacacttcctcctttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaattcagccattcttggctttgggattcttcctgaggaaattgacatctagagaaaatttgctgttgggagttgggttggccatggcaacaacgttacaactgccagaggacattgaacaaatggcgaatggaattgctctggggctcatggctctaaaactgataacacaatttgagacataccagttatggacggcattagtctccctaacgtgttcaaacacaattttcacgttgactgttgcctggagaacagccaccttgattctggccggagtttcgcttttgccagtgtgccagtcttcgagcatgaggaaaacagattggctcccaatggctgtagcagctatgggagttccacccttaccactttttatcttcagcttgaaagatacactcaaaaggaggagctggccactgaatgagggggtgatggctgttgggcttgtgagcattctagctagttctctccttaggaatgatgtgcccatggctggaccactagtggccgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtacagaaagaaggagtcttccacaccatgtggcacgtcacaagaggggcagtgttgacgcacaacggaaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatctcccagccatcgtcagagaagcaatcaagagacgcttaagaactctaattttggcaccaacaagagtggttgcagctgagatggaagaagcactgaaagggctcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcgaaaaaatggaaaaaaggtcattcaacttagtaggaagacttttgacacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctggacaacatcaacacaccagaagggattataccagctctctttgaaccagaaagggagaagtcagccgccatagacggtgaataccgcctgaagggtgagtccaggaagaccttcgtggaactcatgaggaggggtgacctcccagtttggctagcccataaagtagcatcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgcttccagtggcatgttatggatggccgatgtcccacttcaatggatcgcgtcggctatagtcctggaatttttcatgatggtgttgctcataccagaaccagaaaagcagagaactccccaagacaaccaactcgcatatgtcgtgataggcatacttacactggctgcgatagtagcagccaatgaaatgggactattggaaactacgaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactgggctgctattcacaagtgaacccactgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcagctaggacaggttatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgctgtgtccagaggcagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagttaatgagtggaaaggatgtgttttatcttccacctgaaaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccaactgtgattgagcacctagaaagactacaaaggaaatatggaggaatgcttgtgagaaacccactctcacgaaattccacgcacgaaatgtactggatatccaatggtaccggcaacatcgtctcttcagtcaacatggtatccagattgctactgaacagatttacaatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccacggatcctatgaagtcaaagccacaggctcagcctcctccatgataaatggggtcgtgaaactcctcacaaaaccatgggatgtggtgcccatggtgacacagatggcaatgacagatacaactccatttgggcagcaaagagtttttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggccatgggagccgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagatatttccaagatacctggaggagctatgtatgctgatgacacagctggttgggacacaagaataacagaagatgacctgcacaatgaggaaaaaatcacacagcaaatggaccctgaacacagacaattagcgaacgccatattcaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcacctgctagagaagaaaatcacacagtggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaagggttggcatgattggcaacaggtccctttctgctcccaccactttcatgaactgatcatgaaagatggaagaaagttggtggttccctgcagaccccaggacgaactaataggaagagcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgaccacagaagacatgcttactgtctggaacagggtgtggatagaggacaatccatggatggaagacaaaactccagtcgcaacttgggaagatgttccatacctagggaagagagaagatcaatggtgcggatcactcatcggtctcacttccagagcaacctgggcccagaacatactcacagcaatccaacaggtgagaagccttataggcgatgaagagtttctggactacatgccttcgatgaagagattcaggaaggaggaggagtcagagggagccatttggtaa

SEQ ID NO: 1312 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacaggcggaaaaagacatcgctctgtctcatgatgatgttaccagcaacacttgctttccacttgacttcacgagatggagagccgcgcatgattgtggggaagaatgaaagaggaaaatccctgcttttcaagacagcctctggaatcaacatgtgcacactcatagccatggatttgggagaaatgtgtgatgacacggtcacttacaaatgccccctcattactgaagtggagcctgaggacattgactgctggtgcaacctcacatcgacgtgggtgacctacggaacgtgcaaccaagctggagagcatagacgcgataaaagatcggtggcgttagctccccatgttggcatgggactggacacacgcacccaaacctggatgtcggctgaaggagcttggagacaagtcgagaaggtagagacatgggcctttaggcacccagggttcacaatactagccctatttcttgcccattacatagggacttccttgacccagaaagtggtcattttcatactgttaatgttggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagaccgaggccacccaactagcaaccctaaggaaactatgcattgagggaaaaatcaccaacgtgacaaccgactcaaggtgccccacccaaggggaagcgattttacctgaggagcaggaccagaactacgtgtgtaagcacacatacgtggacagaggctggggaaacggttgtggcttgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccgtcttacctgaatatggaacccttgggctagaatgctcaccacgaacaggtttggactttaatgaaatgattttgttgacaatgaagaacaaagcatggatggtacacagacaatggttttttgacctacctctaccatggacatcaggggctacaacagaaacaccaacctggaataagaaagagcttcttgtgacattcaaaaacgcacacgcaaaaaaacaagaagtagtggtccttggatcgcaagagggagcaatgcacacagcactgacaggagctacagagatccaaacctcaggaggcacaagtgtttttgcggggcacttaaaatgcagactcaagatggacaaattggaactcaaggggatgagctatgcaatgtgctcaaatgcctttgtgttgaagaaagaagtctctgaaacacagcatggaacaatactcataaaggtcgagtacaaaggggaagatgcaccttgcaagattcctttctccacggaggatggacaagggaaagcccacaatggcagactgatcacagccaacccagtggtgaccaagaaggaagagcctgtcaatattgaggcagaacctccttttggggaaagtaacataataattggaattggggacaaagccttgaaaatcaattggtacaagaagggaagctcgattgggaagatgttcgaggccactgccagaggtgcaaggcgcatggccatcttgggagacacagcctgggacttcggatcagtaggtggtgttttaaattcattggggaaaatggtgcaccaaatatttggaagcgcttacacggccctttttagtggagtctcctggataatgaaaattggaataggtgtccttttaacttggatagggttgaattcaaaaaacacttctatgtcattttcatgcattgtgattggaatcatcacactctatctgggagctgtggtgcaagctgacatggggtgtgtcataaactggaaaggcaaagaacttaaatgtggaagtggaattttcgttactaatgaggtccacacctggacagagcaatacaaatttcaagcagactccccaaaaagactggcgacagccattgcaggcgcctgggagaatggagtgtgtggaatcaggtcgacaaccagaatggagaacctcttgtggaagcaaatagccaatgaactaaactacatattatgggaaaacaacattaaattaacggtagttgtgggtgatataattggggtcttagagcaagggaaaagaacactaacaccacaacccatggagctaaaatattcatggaaaacatggggaaaggcgaaaatagtgacagctgaaacacaaaattcttccttcataatagatgggcccaacacaccagagtgtccaagtgcctcgagagcatggaatgtgtgggaggtggaagattacgggttcggagttttcacaaccaatatatggctgaaactccgagagatgtacacccaactatgtgaccacaggctaatgtcggcagccgttaaggatgagagagccgtacacgccgacatgggctattggatagaaagccaaaagaatggaagttggaagctagaaaaggcatctctcatagaggtgaaaacctgcacatggccaaagtcacacactctctggagcaatggtgtgttggagagtgatatgatcatcccaaagagtctagctggtcctatctcgcaacacaactacaggcccggataccacacccaaacggcaggaccctggcacctaggaaaactggagctggactttaactattgtgagggaacaacagttgtcatcacagaaaattgtgggacaagaggcccatcactgaggacaacaacagtgtcagggaaattgatacacgaatggtgttgccgctcgtgcacacttcctcctctgcgatacatgggagaagacggctgctggtatggcatggaaattagacccattaatgagaaagaagagaatatggtaaagtctttagtctcagcagggagtggaaaggtggacaacttcacaatgggtgtcttgtgtttggcaatcctctttgaagaggtaatgagaggaaaattcggaaaaaagcacatgattgcaggagttctcttcacatttgtgctccttctctctgggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttgcaactgccagaggacattgaacaaatggcgaatggaatagccttggggctcatggctcttaaattgataacacaattcgaaacataccaactgtggacggcattaacctccctaatgtgttcaaacacaattttcacgttgactgttgcctggagaacagccaccctgattttggccggaatttcgcttttgccagtgtgccagtcttcgagcatgaggaaaacagattggctgccaatgactgtggcagctatgggagttccacctctaccactttttatcttcagtttgaaagacacactcaaaaggagaagctggccactgaatgagggggtgatggccgttggacttgtgagcattttggcaagctctctccttaggaatgacgtacccatggctggaccattagtggctgggggcttgctgatagcgtgctacgtcataactggcacgtcagcagaccttactgtagaaaaagcagcagatgtgacatgggaggaagaggctgagcaaacaggagtgtcccacaatctaatgatcacagttgatgatgatggaacaatgagaataaaagatgatgagactgagaacatcttaacagtgcttttgaaaacagcattactaatagtgtcaggcatttttccatactccatacccgcaacactgttggtctggcatacttggcaaaagcaaacccaaagatccggcgtcctatgggacgtacctagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacgacaggggagataggagcgattgcactggacttcaagcctggaacttcaggatctcccatcataaacagagagggaaaggtagtgggactgtatggcaatggagtggtcacaaagagtggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagccatagttagagaggcaatcaagagacgcttaaggaccctaattttggcaccaacaagggtggttgcagctgagatggaagaagcattgaaagggctcccaataaggtatcaaacaactgcaacaaaatccgaacacacagggaaagagattgttgatctaatgtgtcatgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacaccccctggaacagctgatgcctttcctcagagcaacgctccaattcaagatgaagaaagagacatcccagaacgctcatggaattcaggcaatgattggattaccgactttgccgggaagactgtgtggtttgtccccagcatcaaagctggaaatgacatagcaaactgcttgcgaaaaaatggaaaaaaggtcattcaacttagtaggaaaacttttgacacagaatatcaaaagactaaactaaatgattgggactttgtggtgacaacagacatttcggaaatgggagccaatttcaaagcagacagagtgatcgacccaagaagatgtctcaagccagtcattttgacagacggacccgagcgtgtgatcctggcaggaccaatgccagtcaccgtagcgagtgctgcacaaaggagagggagagttggcaggaacccacaaaaagaaaatgaccaatacatattcacgggccagcccctcaacaatgatgaagaccacgctcactggacagaagcaaaaatgctgctagacaacattaacacaccagaagggatcataccagctctctttgaaccagaaagggagaagtcagccgccatagacggcgaataccgcctgaaaggtgagtcccggaagactttcgtggaactcatgaggaggggtgacctcccagtttggctagcccataaagtagcatcagaaggaatcaaatacacagatagaaaatggtgttttgatggagagcgcaacaatcaaattttagaggagaatatggatgtggaaatttggacaaaggaaggagaaaagaaaaaattgaggcctaggtggcttgacgcccgcacttattcagatcccttagcgctcaaggaattcaaggactttgcggctggtagaaagtcgatcgcctttgatcttgtaacagaaataggaagagtgccttcacatttagcccacagaacgagaaatgctctggacaatttggtaatgttgcacacgtcagaacacggtgggagggcctacaggcatgcagtggaggaattaccagaaacaatggaaacactcttactcctgggactcatgatcctgttaacaggtggggcaatgcttttcttgatatcaggcaaagggattggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagataatcaactcgcatatgtcgtgataggcatacttacattggctgcaatagtagcagccaatgaaatgggattgttggaaaccacaaagagagatttggggatgtccaaagaaccaggtgttgtttctccaaccagctatttggatgtggatttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggatttaggcgtaccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaacccaacggtggatgggataatgacaatagacctagatcctgtaatatacgattcaaaatttgaaaaacaactaggacaagttatgctcctggttctgtgtgcagttcaactcttgttaatgagaacatcatgggcattttgtgaagctctaaccctagccacaggaccaataacaacactctgggaaggatcaccagggaagttctggaacaccacgatagctgtttccatggcgaacatctttagagggagctatttagcaggagctgggctcgctttttctatcatgaaatcagttggaacaggaaagagaggaacagggtcacaaggtgaaactttgggagaaaagtggaaaaagaaattgaatcaattgtcccggaaagagtttgacctttacaagaaatccggaatcactgaagtggatagaacagaagctaaagaagggttgaaaagaggagaaataacacaccatgccgtatccagaggcagcgcaaaacttcaatggttcgtggagagaaacatggtcatccctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctaatgagtggaaaggatgtgttttatcttccacctgaaaagtgtgacactctattgtgtgacattggagagtcttcaccaagcccaacagtggaagagagcagaaccataagagtcttgaaaatggttgaaccatggctaaaaaacaaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactactactgaacagattcacaatgacatataggagacccaccatagagaaagatgtggatttaggagcggggacccgacatgtcaatgcggaaccagaaacacctaacatggatgtcattggggaaagaataaggaggattaaggaggagcatagttcaacatggcactatgatgatgaaaatccttacaaaacgtgggcttaccatggatcttatgaagttaaggccacaggttcagcctcctccatgataaatggagtcgtaaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggtcatggagatcacagcagaatggctctggagaaccctgggaaggaataaaagacccagattatgcacgagagaggagttcacaaaaaaggtcagaaccaacgcagctatgggcgccgtattcacagaggagaaccaatgggacagtgccagagctgccgttgaagatgaagaattctggaaactcgtggacagagaacgtgagctccacaaactgggcaagtgtggaagctgcgtttataacatgatgggcaagagagagaagaaacttggagagtttggcaaagcaaaaggcagtagagccatatggtacatgtggctgggagccaggtaccttgagttcgaggcactcggattcttaaatgaagaccattggttctcgcgcgaaaactcttacagtggagtagaaggggaaggactgcataagctgggatacatcttgagagacatttccaagataccaggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgattagacaaatggaaggagaaggtgtgttgtcgaagacagacctcgagaaccctcatctgctagagaagagaattacacaatggttggaaaccaaaggagtggagaggttaaaaagaatggccatcagcggggacgattgcgtggtgaaaccaatcgatgacaggttcgccaatgccctgcttgccctgaatgacatgggaaaagttaggaaggacatacctcaatggcaaccatcgaagggatggcatgattggcaacaggtccctttctgctcccaccactttcatgaattgattatgaaagatggaagaaagttggtagtcccctgcagacctcaggatgaattaatagggagagcgagaatctctcaaggagcaggatggagccttaaagaaactgcatgcctagggaaagcctacgcccaaatgtgggctctcatgtattttcacagaagagatcttagactagcctccaacgccatatgttcagcagtaccagtccattgggtccccacaagcagaacgacttggtccatccatgctcaccatcagtggatgactacagaagatatgcttactgtttggaacagggtgtggatagaggacaatccatggatggaagataaaactccagttacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 1313 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcgttcatagctttcctcagatttctagccattccaccgacagcgggaatcttggctagatggggaaccttcaagaagtcgggggctattaaggtcctgagaggcttcaagaaggagatctcaaatatgctgagcattatcaacaggcggaaaaagacatcgctctgtctcatgatgatgttaccagcaacacttgctttccacttgacttcacgagatggagagccgcgcatgattgtggggaagaatgaaagaggaaaatccctgcttttcaagacagcctctggaatcaacatgtgcacactcatagccatggatttgggagaaatgtgtgatgacacggtcacttacaaatgccccctcatcactgaagtggagcctgaggacattgactgctggtgcaacctcacatcgacgtgggtgacctacggaacgtgcaaccaagctggagagcatagacgcgataaaagatcggtggcgttagctccccatgttggcatgggactggacacacgcacccaaacctggatgtcggctgaaggagcttggagacaagtcgagaaggtagagacatgggcctttaggcacccagggttcacaatactagccctatttcttgcccattacatagggacttccttgacccagaaagtggtcattttcatactgctaatgttggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagaccgaggccacccaactagcaaccctaaggaaactatgcattgagggaaaaatcaccaacgtgacaactgactcaaggtgccccacccaaggggaagcgattttacctgaggagcaggaccagaactacgtgtgtaagcacacatacgtggacagaggctggggaaacggttgtggcttgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccgtcttacctgaatatggaacccttgggctagaatgctcaccacggacaggtttggactttaatgaaatgattttgttgacaatgaagaacaaagcatggatggtacacagacaatggttttttgacctacctctaccatggacatcaggggccacaacagaaacaccaacctggaataagaaagagcttcttgtgacattcaaaaacgcacacgcaaaaaaacaagaagtagtggtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgctcaaatgcctttgtgttgaagaaagaagtctctgaaacacagcatggaacaatactcataaaggtcgagtacaaaggggaagatgcaccctgcaagattcctttctccacggaggatggacaagggaaagcccacaatggcagactgatcacagccaacccagtggtgaccaagaaggaagagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcattggggaaaatggtgcaccaaatatttggaagcgcttacacggccctttttagtggagtctcctggataatgaaaattggaataggtgtccttttaacttggatagggttgaattcaaaaaacacttctatgtcattttcatgcattgtgattggaatcatcacactctatctgggagctgtggtgcaagctgacatggggtgtgtcataaactggaaaggcaaagaacttaaatgtggaagtggaattttcgttactaatgaggtccacacctggacagagcaatacaaatttcaagcagactccccaaaaagactggcgacagccattgcaggcgcctgggagaatggagtgtgtggaatcaggtcgacaaccagaatggagaacctcttgtggaagcaaatagccaatgaactaaactacatattatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaacacaaaattcttccttcataatagatgggcccaacacaccagagtgtccaagtgcctcgagagcatggaatgtgtgggaggtggaagattacgggttcggagttttcacaaccaatatatggctgaaactccgagagatgtacacccaactatgtgaccacaggctaatgtcggcagctgttaaggatgagagagccgtacacgccgacatgggctattggatagaaagccaaaagaatggaagttggaagctagaaaaggcatctctcatagaggtgaaaacctgcacatggccaaagtcacacactctctggagcaatggtgtgttggagagtgatatgatcatcccaaagagtctggctggtcctatctcgcaacacaactacaggcccggataccacacccaaacggcaggaccctggcacctaggaaaattggagctggactttaactattgtgagggaacaacagttgtcatcacagaaaattgtgggacaagaggcccatcactgaggaccacaacagtgtcagggaaattgatacacgaatggtgttgccgctcgtgcacacttcctcctctgcgatacatgggagaagacggctgctggtatggcatggaaattagacccattaatgagaaagaagagaatatggtaaagtctttagtctcagcagggagtggaaaggtggacaacttcacaatgggtgtcttgtgtttggcaatcctctttgaagaggtaatgagaggaaaattcggaaaaaagcacatgattgcaggggttctcttcacatttgtgctccttctctccgggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggttggccatggcaacaacgttgcaactgccagaggacattgaacaaatggcgaatggaatagccttggggctcatggctcttaaattgataacacaattcgaaacataccaattgtggacggcattagcctccctaatgtgttcaaacacaattttcacgttgactgttgcctggagaacagccaccctgattttggccggaatttcgcttttgccagtgtgccagtcttcgagcatgaggaaaacagattggctaccaatgactgtggcagctatgggagttccacctctaccactttttatcttcagtttgaaagacacactcaaaaggagaagctggccactgaatgagggggtgatggccgttggacttgtgagcattttggcaagctctctccttaggaatgacgtacccatggctggaccattagtggctgggggcttgctgatagcgtgctacgtcataactggcacgtcagcagaccttactgtagaaaaagcagcagatgtgacatgggaggaagaggctgagcaaacaggagtgtcccacaatctaatgatcacagttgatgatgatggaacaatgagaataaaagatgatgagactgagaacatcttaacagtgcttttgaaaacagcattactaatagtgtcaggcatttttccatactccatacccgcaacactgttggtctggcatacttggcaaaagcaaacccaaagatccggcgtcctatgggacgtacctagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacgacaggggagataggagcgattgcactggacttcaagcctggaacttcaggatctcccatcataaacagagagggaaaggtagtgggactgtatggcaatggagtggtcacaaagagtggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagccatagttagagaggcaatcaagagacgcttaaggaccctaattttggcaccaacaagggtggttgcagctgagatggaagaagcattgaaagggctcccaataaggtatcaaacaactgcaacaaaatccgaacacacagggaaagagattgttgatctaatgtgtcatgcaacgttcacaatgcgtttgctgtcaccagtcagagttccaaactacaacttgataataatggatgaggctcatttcacagacccagccagtatagcggctagagggtacatatcaactcgtgtgggaatgggagaggcagccgcaattttcatgacagccacaccccctggaacagctgatgcctttcctcagagcaacgctccaattcaagatgaagaaagagacatcccagaacgctcatggaattcaggcaatgattggattaccgactttgccgggaagactgtgtggtttgtccccagcatcaaagctggaaatgacatagcaaactgcttgcgaaaaaatggaaaaaaggtcattcaacttagtaggaaaacttttgacacagaatatcaaaagactaaactaaatgattgggactttgtggtgacaacagacatttcggaaatgggagccaatttcaaagcagacagagtgatcgacccaagaagatgtctcaagccagtcattttgacagacggacccgagcgtgtgatcctggcaggaccaatgccagtcaccgtagcgagtgctgcacaaaggagagggagagttggcaggaacccacaaaaagaaaatgaccaatacatattcacgggccagcccctcaacaatgatgaagaccacgctcactggacagaagcaaaaatgctgctagacaacattaacacaccagaagggatcataccagctctctttgaaccagaaagggagaagtcagccgccatagacggcgaataccgcctgaaaggtgagtcccggaagactttcgtggaactcatgaggaggggtgacctcccagtttggctagcccataaagtagcatcagaaggaatcaaatacacagatagaaaatggtgttttgatggagagcgcaacaatcaaattttagaggagaatatggatgtggaaatttggacaaaggaaggagaaaagaaaaaattgaggcctaggtggcttgacgcccgcacttattcagatcccttagcgctcaaggaattcaaggactttgcggctggtagaaagtcgatcgcctttgatcttgtaacagaaataggaagagtgccttcacatttagcccacagaacgagaaatgctctggacaatttggtaatgttgcacacgtcagaacacggtgggagggcctacaggcatgcagtggaggaattaccagaaacaatggaaacactcttactcctgggactcatgatcctgttaacaggtggggcaatgcttttcttgatatcaggcaaagggattggaaagacttcaataggacttatttgtgtagttgcttccagcggcatgttatggatggctgatatcccactccaatggatcgcgtcggccatagttctggagttttttatgatggtgctacttataccagaaccagaaaagcagagaactccccaagataatcaactcgcatatgtcgtgataggcatacttacattggctgcaatagtagcggccaatgaaatgggattgttggaaaccacaaagagagatttggggatgtccaaagaaccaggtgttgtctctccaaccagctatttggatgtggatttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggatttaggcgtaccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaacccaacggtggatgggataatgacaatagacctagatcctgtaatatacgattcaaaatttgaaaaacaactaggacaagttatgctcctggttctgtgtgcagttcaactcttgttaatgagaacatcatgggcattttgtgaagctctaaccctagccacaggaccaataacaacactctgggaaggatcaccagggaagttctggaacaccacgatagctgtttccatggcgaacatctttagagggagctatttagcaggagctgggctcgctttttctatcatgaaatcagttggaacaggaaagagaggaacagggtcacaaggtgaaactttgggagaaaagtggaaaaagaaattgaatcaattgtcccggaaagagttcgacctttacaagaaatccggaatcactgaagtggatagaacagaagctaaagaagggttgaaaagaggagaaataacacaccatgccgtatccagaggcagcgcaaaacttcaatggttcgtggagagaaacatggtcatccctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctaatgagtggaaaggatgtgttttatcttccacctgaaaagtgtgacactctattgtgtgacattggagagtcttcaccaagcccaacagtggaagagagcagaaccataagagtcttgaaaatggttgaaccatggctaaaaaacaaccagttttgcatcaaagtattgaacccttatatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactactactgaacagattcacaatgacatataggagacccaccatagagaaagatgtggatttaggagcggggacccgacatgtcaatgcggaaccagaaacacctaacatggatgtcattggggaaagaataaggaggattaaggaggagcatagttcaacatggcactatgatgatgaaaatccttacaaaacgtgggcttaccatggatcttatgaagttaaggccacaggttcagcctcctccatgataaatggagtcgtaaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggtcatggagatcacagcagaatggctttggagaaccctgggaaggaataaaagacccagattatgcacgagagaggagttcacaaaaaaggtcagaaccaacgcagctatgggcgccgtattcacagaggagaaccaatgggacagtgccagagctgccgttgaagatgaagaattctggaaactcgtggacagagaacgtgagctccacaaactgggcaagtgtggaagctgcgtttataacatgatgggcaagagagagaagaaacttggagagtttggcaaagcaaaaggcagtagagccatatggtacatgtggctgggagccaggtaccttgagttcgaggcactcggattcttaaatgaagaccattggttctcgcgtgaaaactcttacagtggagtagaaggggaaggactgcataagctgggatacatcttgagagacatttccaagataccaggaggagccatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgattagacaaatggaaggagaaggtgtgttgtcgaagacagacctcgagaaccctcatctgctagagaagagaattacacaatggttggaaaccaaaggagtggagaggttaaaaagaatggccatcagcggggacgattgcgtggtgaaaccaatcgatgacaggttcgccaatgccctgcttgccctgaatgatatgggaaaagttaggaaggacatacctcaatggcaaccatcgaagggatggcatgattggcaacaggtccctttctgctcccaccactttcatgaattgattatgaaagatggaagaaagttggtagtcccctgcagacctcaggatgaattaatagggagagcgagaatctctcaaggagcaggatggagccttaaagaaactgcatgcctagggaaagcctacgcccaaatgtgggctctcatgtattttcacagaagagatcttagactagcctccaacgccatatgttcagcagtaccagtccattgggtccccacaagcagaacgacttggtccatccatgctcaccatcagtggatgactacagaagatatgcttactgtttggaacagggtgtggatagaggacaatccatggatggaagacaaaactccagttacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagttagagggagccatttggtaa

SEQ ID NO: 1314 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccgacagcaggagtcttggctagatggggaacctttaagaagtcgggggccattaaggtcctgagaggcttcaagaaggagatctcaaacatgctgagcattatcaacagacggaaaaagacatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaagctatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagtggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcccttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgatagggatcattacactctatctgggagccgtggtgcaagctgacatggggtgtgtcataaactggaaaggccaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacggtagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgtcaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacattcaaaattcagccatttttggctttgggattcttcctgaggaaactgacatccagagaaaatttattgctgggagttgggttggccatggcaacaacgttacaactgccagaggacattgaacaaatggcgaatggaatagctttagggctcatggctcttaaattaataacacaatttgaaacataccaactatggacggcattggtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacctctaccacttttcattttcagtttaaaagatacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgctagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaactctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatatcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattgtgtacgagagaggagttcatgaaaaaagtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtatatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaagcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagcgagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtctcaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 1315 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccaacagcaggagtcttggctagatggggaaccttcaagaagtcaggggctattaaggtcctaaaaggcttcaagaaggagatttcaaacatgctgagcatcatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacttacaaatgccccttcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggacacacgcacccagacctggatgtcggctgaaggagcttggagacaagtcgagaaggtagagacatgggctcttaggcacccagggtttaccatactagctctatttctagcccattacataggcacttccctgacccagaaagtggttatttttgtactactaatgctggtcactccatccatggctatgagatgcgtgggagtaggaaacagagattttgtggaaggtctgtcgggagcaacgtgggttgatgtggtgctcgagcacggtgggtgtgtgaccaccatggctaagaacaagcctacgctggacatagagcttcagaagaccgaggccacccaactggcgaccctacggaagttatgcattgagggtaaaattaccaacataacaactgactcaaggtgtcctacccagggggaagcgactttacctgaggagcaggaccagaactacgtgtgtaagcacacatacgtggatagaggttggggaaacggttgtggtttgtttggaaaaggaagcttggtgacatgcgcaaaatttcaatgtttagaaccaatagagggaaaagtggtgcaacatgagaacctcaaatacactgtcaccattacagtgcacacaggagaccaacaccaggtgggaaatgacacgcagggagtcacggttgagataacaccccaggcatcaaccgttgaagctgtcttgcctgaatatggaacccttgggctagaatgttcaccacgcacaggtttggatttcaatgaaatgattctattgacaatgaagaacaaagcatggatggtacataggcaatggttctttgacctacccctaccatggacatcaggagccacaacagaaacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatctttgcagggcacttgaaatgtagactcaagatggacaaattggaactcaaggggatgagctatgcaatgtgcttgaatacctttgtgttgaagaaagaagtctctgaaacgcagcatgggacaatactcattaaagttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgatcggaattggagacaaagccttgaaaattaactggtacaagaaaggaagctcgatcgggaagatgttcgaggccactgccagaggtgcaaggcgcatggctatcttgggagacacagcctgggactttggatcagtgggtggtgttctaaattcattagggaaaatggtgcaccaaatattcggaagtgcttacacagccctgtttggtggagtctcatggataatgaaaattggaataggtgtcctcttaacctggatagggttgaattcaaaaaacacttccatgtcattttcatgcattgtgataggaattattacactctatctaggaactgtggtacaagctgacatggggtgtgtcataaactggaaaggaaaagaactcaaatgtggaagtggaatcttcgtcactaatgaggtccacacctggacagagcaatacaaattccaagcagactcccctaaaagactggcgacagccattgcaggcgcttgggaaaatggagtctgcggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggtttggagtcttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctggctggtcctatttcgcaacacaaccacaggcccggataccacacccaaacggcaggaccctggcacttgggaaaattggagctggacttcaactattgtgaaggaacaacagtagtcatcacagaagattgcgggacaagaggcccatcattgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagagggaaatttgggaaaaaacatatgattgcaggggttctcttcacgtttgtgctccttctctcagggcaaataacatggagagatatggcaaacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgagacataccagttgtggacggcattaatctccctaacatgttcaaacacaattttcacgttgactgttgcctggagaacagccaccttgattctggccggagtttcgcttttgccagtgtgccagtcttcgagcatgaggaaaacagattggctcccagtggctgtggcagctatgggagttccatccttaccactttttatcttcagcttgaaagatacactcaaaaggaggagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagcagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaacaacaaggaatttttggaaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaccgttcacaatgcgcttgctatcaccagtcagggttccaaattacaatttgataataatggatgaggcccatttcacagatccagccagtatagcggctagagggtacatatcaactcgtgtaggaatgggagagacagccgcaatcttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgttcctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgattctggctggaccaatgccagtcaccgcagcgagcgctgcgcaaaggagagggagagtcggcaggaacccacaaaaagaaaatgaccagtacatattcacgggccagcccctcaacaatgacgaagaccatgctcactggacagaagcaaaaatgctgctagacaacatcaacacaccagaagggattataccagctctctttgaaccagaaagggagaagtcagccgctatagacggtgaataccgcctgaagggtgagtccagaaagaccttcgtggaacttatgaggaggggtgacctcccagtttggctagcccataaagtagcatcagaagggatcaaatacacagatagaaaatggtgctttgatggagaacgcaataatcaaattttagaggagaacatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtagggcctataggcatgcggtggaggaactaccagaaacaatggaaacactcctactcttgggactcatgatcctgttaacaggtggagcgatgcttttcctgatatcaggtagagggattggaaaggcttcaatagggctcatttgtgttattgtttccagtggcatgttatggatggccgatgtcccgcttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcacagcggcggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactgggacaggttatgcttctggtcctgtgtgcagttcaacttctgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctgggcttgccttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtctagaggaagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatatggatggaacatagttaagttaatgagtggaaaggatgtgttttatcttccacctgaaaagtgtgacaccctattgtgtgacattggagaatcttcaccaagcccaacagtagaagaaagcagaactataagagttttgaagatggttgaaccatggctaaaaaacaaccagttctgcataaaagtattaaacccttacatgccaactgtgattgaacacctagaaagactgcaaagaaaatatggaggaatgcttgtgagaaacccactctcacgaaactccacgcacgaaatgtactggatatccaatggtaccggcaacatcgtctcttcagtcaacatggtatccagattgctactgaacagattcacaatgacacacagaaaacccaccatagagaaagatgtggatttgggagcaggaactcgacatgtcaatgcggaaccagaaacacccaacatggacgtcattggagaaagaataaaaaggatcaaggagggagttagtaaaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttggccagcaaagagttttcaaagagaaagtggacaccaggacacccaggcccatgccaggaacaagaaaggttatggagatcacagcggaatggctttggagaaccctaggaaggaacaaaagacctagactgtgcacaagggaagaatttacaaaaaaggtcagaaccaacgcggctatgggagccgtcttcacagaggagaaccaatgggatagtgcgagagctgtcgttgaagacgaagaattctggaaacttgtggacagagaacgtgaactccacaagttgggcaagtgtggaagctgcgtctacaacatgatgggtaagagagagaagaaacttggagagtttggcaaagcaaaaggcagtagagctatatggtatatgtggttgggagccaggtaccttgagttcgaagcactcggatttttaaatgaagaccactggttctcgcgtgaaaactcttacagtggagtagaaggagaaggactgcacaagttgggatacatcttaagagatatctccaagatacctggaggagctatgtatgctgatgacacagctggttgggacacaagaatacaggaagatgacctacacaatgaggaaaaaatcacacagcaaatggaccctgaacacagacaattggcgaacgccatattcaagctcacgtaccaaaataaagtggttaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgccagagaagaaaatcacacaatggttggaaaccgaaggagtggagagattaaagagaatggccatcagcggggatgattgcgtggtgaaaccgatcgatgacaggtttgccaatgccctgtttgccctgaacgatatgggaaaggtaaggaaggacatacctcaatggcagccatcaaagggctggcatgattggcaacaggttcctttctgctcccatcattttcatgaactgatcatgaaagatggaagaaagttggtggttccctgcagaccccaggacgaactaataggaagagcgaggatctctcaaggagcaggatggagcctcaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcaatgaagagtttctggactacatgccttcgatgaagagattcaggaaggaggaggagtcagagggagccatttggtaa

SEQ ID NO: 1316 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccaacagcaggagtcttggctagatggggaaccttcaagaagtcaggggctattaaggtcctaaaaggcttcaagaaggagatttcaaacatgctgagcatcatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacctacaaatgccccttcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttgtactactaatgctggtcactccatccatggctatgagatgcgtgggagtaggaaacagagattttgtggaaggtctgtcgggagcaacgtgggttgatgtggtgctcgagcacggtgggtgtgtgaccaccatggctaagaataagcctacgctggacatagagcttcagaagaccgaggccacccaactggcgaccctaaggaagttatgcattgagggtaaaattaccaacataacaactgactcaaggtgtcctacccagggggaagcgactttacctgaggagcaggaccagaactacgtgtgtaagcacacatacgtggatagaggttggggaaacggttgtggtttgtttggaaaaggaagcttggtgacatgcgcaaaatttcaatgtttagaaccaatagagggaaaagtggtgcaacatgagaacctcaaatacactgtcaccattacagtgcacacaggagaccaacaccaggtgggaaatgacacgcagggagtcacggttgagataacaccccaggcatcaaccgttgaagctgtcttgcctgaatatggaacccttgggctagaatgttcaccacgcacaggtttggatttcaatgaaatgattctattgacaatgaagaacaaagcatggatggtacataggcaatggttctttgacctacccctaccatggacatcaggagccacaacagaaacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatctttgcagggcacttgaaatgtagactcaagatggacaaattggaactcaaggggatgagctatgcaatgtgcttgaatacctttgtgttgaagaaagaagtctctgaaacgcagcatgggacaatactcattaaagttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgatcggaattggagacaaagccttgaaaattaactggtacaagaaaggaagctcgatcgggaagatgttcgaggccactgccagaggtgcaaggcgcatggctatcttgggagacacagcctgggactttggatcagtgggtggtgttctaaattcattagggaaaatggtgcaccaaatattcggaagtgcttacacagccctgtttggtggagtctcatggataatgaaaattggaataggtgtcctcttaacctggatagggttgaattcaaaaaacacttccatgtcattttcatgcattgtgataggaattattacactctatctaggaactgtggtacaagctgacatggggtgtgtcataaactggaaaggaaaagaactcaaatgtggaagtggaatcttcgtcactaatgaggtccacacctggacagagcaatacaaatttcaagcagactcccctaaaagactggcgacagccattgcaggcgcttgggaaaatggagtctgcggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggtttggagtcttcacaaccaacatatggctgaaactccgagaggtgtacacccaaacatgtgaccataggctaatgtcggcagccatcaaagatgagagggctgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctggctggtcctatttcgcaacacaaccacaggcccggataccacacccaaacggcaggaccctggcacttgggaaaattggagctggacttcaactattgtgaaggaacaacagtagtcatcacagaagattgcgggacaagaggcccatcattgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagagggaaatttgggaaaaaacatatgattgcaggggttctcttcacgtttgtgctccttctctcagggcaaataacatggagagatatggcacacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgagacataccagttgtggacggcattaatctccctaacatgttcaaacacaattttcacgttgactgttgcctggagaacagccaccttgattctggccggagtttcgcttttgccagtgtgccagtcttcgagcatgaggaaaacagattggctcccagtggctgtggcagctatgggagttccatccttaccactttttatcttcagcttgaaagatacactcaaaaggaggagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagcagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaacaacaaggaatttttggaaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacataggcaaaagggagaggaggtgcaggttattgccgtagagcctgggaagaacccaaaaaactttcaaaccatgccgggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagagacagccgcaatcttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgttcctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgattctggctggaccaatgccagtcaccgcagcgagcgctgcgcaaaggagagggagagtcggcaggaacccacaaaaagaaaatgaccagtacatattcacgggccagcccctcaacaatgacgaagaccatgctcactggacagaagcaaaaatgctgctagacaacatcaacacaccagaagggattataccagctctctttgaaccagaaagggagaagtcagccgctatagacggtgaataccgcctgaagggtgagtccagaaagaccttcgtggaacttatgaggaggggtgacctcccagtttggctagcccataaagtagcatcagaagggatcaaatacacagatagaaaatggtgctttgatggagaacgcaataatcaaattttagaggagaacatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtagggcctataggcatgcggtggaggaactaccagaaacaatggaaacactcctactcttgggactcatgatcctgttaacaggtggagcgatgcttttcctgatatcaggtagagggattggaaaggcttcaatagggctcatttgtgttattgtttccagtggcatgttatggatggccgatgtcccgcttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcacagcggtggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactaggacaggttatgcttctggtcctgtgtgcagttcaacttctgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctgggcttgccttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtctagaggaagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatatggatggaacatagttaagttaatgagtggaaaggatgtgttttatcttccacctgaaaagtgtgacaccctattgtgtgacattggagaatcttcaccaagcccaacagtagaagaaagcagaactataagagttttgaagatggttgaaccatggctaaaaaacaaccagttctgcataaaagtattaaacccttacatgccaactgtgattgaacacctagaaagactgcaaagaaaatatggaggaatgcttgtgagaaacccactctcacgaaactccacgcacgaaatgtactggatatccaatggtaccggcaacatcgtctcttcagtcaacatggtatccagattgctactgaacagattcacaatgacacacagaagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggcaaagcaaaaggcagtagagctatatggtatatgtggttgggagccaggtaccttgagttcgaggcactcggatttttaaatgaagaccactggttctcgcgtgaaaactcttacagtggagtagaaggagaaggactgcacaagttgggatacatcttaagagatatctccaagatacctggaggagctatgtatgctgatgacacagctggttgggacacaagaataacagaagatgacctacacaatgaggaaaaaatcacacagcaaatggaccctgaacacagacaattggcgaacgccatattcaagctcacgtaccaaaataaagtggttaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgccagagaagaaaatcacacaatggttggaaaccgaaggagtggagagattaaagagaatggccatcagcggggatgattgcgtggtgaaaccgatcgatgacaggtttgccaatgccctgtttgccctgaacgatatgggaaaggtaaggaaggacatacctcaatggcagccatcaaagggctggcatgattggcaacaggtccctttctgctcccatcattttcatgaactgatcatgaaagatggaagaaagttggtggttccctgcagaccccaggacgaactaataggaagagcgaggatctctcaaggagcaggatggagcctcaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcaatgaagagtttctggactacatgccttcgatgaagagattcaggaaggaggaggagtcagagggagccatttggtaa

SEQ ID NO: 1317 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccaacagcaggagtcttggctagatggggaaccttcaagaagtcaggggctattaaggtcctaaaaggcttcaagaaggagatttcaaacatgctgagcatcatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacctacaaatgccccttcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttgtactactaatgctggtcactccatccatggctatgagatgcgtgggagtaggaaacagagattttgtggaaggtctgtcgggagcaacgtgggttgatgtggtgctcgagcacggtgggtgtgtgaccaccatggctaagaataagcctacgctggacatagagcttcagaagaccgaggccacccaactggcgaccctaaggaagttatgcattgagggtaaaattaccaacataacaactgactcaaggtgtcctacccagggggaagcgactttgcctgaggagcaggaccagaactacgtgtgtaagcacacatacgtggatagaggttggggaaacggttgtggtttgtttggaaaaggaagcttggtgacatgcgcaaaatttcaatgtttagaaccaatagagggaaaagtggtgcaacatgagaacctcaaatacactgtcaccattacagtgcacacaggaactcaacaccaggtgggaaatgacacgcagggagtcacggttgagataacaccccaggcatcaaccgttgaagctgtcttgcctgaatatggaacccttgggctagaatgttcaccacgcacaggtttggatttcaatgaaatgattctattgacaatgaagaacaaagcatggatggtacataggcaatggttctttgacctacccctaccatggacatcaggagccacaacagaaacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatctttgcagggcacttgaaatgtagactcaagatggacaaattggaactcaaggggatgagctatgcaatgtgcttgaatacctttgtgttgaagaaagaagtctctgaaacgcagcatgggacaatactcattaaagttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgatcggaattggagacaaagccttgaaaattaactggtacaagaaaggaagctcgatcgggaagatgttcgaggccactgccagaggtgcaaggcgcatggctatcttgggagacacagcctgggactttggatcagtgggtggtgttctaaattcattagggaaaatggtgcaccaaatattcggaagtgcttacacagccctgtttggtggagtctcatggataatgaaaattggaataggtgtcctcttaacctggatagggttgaattcaaaaaacacttccatgtcattttcatgcattgtgataggaattattacactctatctaggaactgtggtacaagctgacatggggtgtgtcataaactggaaaggaaaagaactcaaatgtggaagtggaatcttcgtcactaatgaggtccacacctggacagagcaatacaaatttcaagcagactcccctaaaagactggcgacagccattgcaggcgcttgggaaaatggagtctgcggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggtttggagtcttcacaaccaacatatggctgaaactccgagaggtgtacacccaaacatgtgaccataggctaatgtcggcagccatcaaagatgagagggctgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctggctggtcctatttcgcaacacaaccacaggcccggataccacacccaaacggcaggaccctggcacttgggaaaattggagctggacttcaactattgtgaaggaacaacagtagtcatcacagaagattgcgggacaagaggcccatcattgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagagggaaatttgggaaaaaacatatgattgcaggggttctcttcacgtttgtgctccttctctcagggcaaataacatggagagatatggcacacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgagacataccagttgtggacggcattaatctccctaacatgttcaaacacaattttcacgttgactgttgcctggagaacagccaccttgattctggccggagtttcgcttttgccagtgtgccagtcttcgagcatgaggaaaacagattggctcccagtggctgtggcagctatgggagttccatccttaccactttttatcttcagcttgaaagatacactcaaaaggaggagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagtagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaacaacaaggaatttttggaaaaacccaagtgggggttggagtacagaaagaaggagtcttccacaccatgtggcacgtcacaagaggggcagtgttgacgcacaatgggaaaagactggaaccaaactgggccagtgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagagacagccgcaatcttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgttcctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgattctggctggaccaatgccagtcaccgcagcgagcgctgcgcaaaggagagggagagtcggcaggaacccacaaaaagaaaatgaccagtacatattcacgggccagcccctcaacaatgacgaagaccatgctcactggacagaagcaaaaatgctgctagacaacatcaacacaccagaagggattataccagctctctttgaaccagaaagggagaagtcagccgctatagacggtgaataccgcctgaagggtgagtccagaaagaccttcgtggaacttatgaggaggggtgacctcccagtttggctagcccataaagtagcatcagaagggatcaaatacacagatagaaaatggtgctttgatggagaacgcaataatcaaattttagaggagaacatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtagggcctataggcatgcggtggaggaactaccagaaacaatggaaacactcctactcttgggactcatgatcctgttaacaggtggagcgatgcttttcctgatatcaggtagagggattggaaaggcttcaatagggctcatttgtgttattgtttccagtggcatgttatggatggccgatgtcccgcttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcacagcggcggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactgggacaggttatgcttctggtcctgtgtgcagttcaacttctgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctgggcttgccttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtctagaggaagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatatggatggaacatagttaagttaatgagtggaaaggatgtgttttatcttccacctgaaaagtgtgacaccctattgtgtgacattggagaatcttcaccaagcccaacagtagaagaaagcagaactataagagttttgaagatggttgaaccatggctaaaaaacaaccagttctgcataaaagtattaaacccttacatgccaactgtgattgaacacctagaaagactgcaaagaaaatatggaggaatgcttgtgagaaacccactctcacgaaactccacgcacgaaatgtactggatatccaatggtaccggcaacatcgtctcttcagtcaacatggtatccagattgctactgaacagattcacaatgacacacagaaaacccaccatagagaaagatgtggatttgggagcaggaactcgacatgtcaatgcggaaccagaaacacccaacatggacgtcattggagaaagaataaaaaggatcaaggaggaacatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggcaaagcaaaaggcagtagagctatatggtatatgtggttgggagccaggtaccttgagttcgaagcactcggatttttaaatgaagaccactggttctcgcgtgaaaactcttacagtggagtagaaggagaaggactgcacaagttgggatacatcttaagagatatctccaagatacctggaggagctatgtatgctgatgacacagctggttgggacacaagaataacagaagatgacctacacaatgaggaaaaaatcacacagcaaatggaccctgaacacagacaattggcgaacgccatattcaagctcacgtaccaaaataaagtggttaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgccagagaagaaaatcacacaatggttggaaaccgaaggagtggagagattaaagagaatggccatcagcggggatgattgcgtggtgaaaccgatcgatgacaggtttgccaatgccctgtttgccctgaacgatatgggaaaggtaaggaaggacatacctcaatggcagccatcaaagggctggcatgattggcaacaggtccctttctgctcccatcattttcatgaactgatcatgaaagatggaagaaagttggtggttccctgcagaccccaggacgaactaataggaagagcgaggatctctcaaggagcaggatggagcctcaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcaatgaagagtttctggactacatgccttcgatgaagagattcaggaaggaggaggagtcagagggagccatttggtaa

SEQ ID NO: 1318 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccaacagcaggagtcttggctagatggggaaccttcaagaagtcaggggctattaaggtcctaaaaggcttcaagaaggagatttcaaacatgctgagcatcatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacctacaaatgccccttcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttgtactactaatgctggtcactccatccatggctatgagatgcgtgggagtaggaaacagagattttgtggaaggtctgtcgggagcaacgtgggttgatgtggtgctcgagcacggtgggtgtgtgaccaccatggctaagaataagcctacgctggacatagagcttcagaagaccgaggccacccaactggcgaccctaaggaagttatgcattgagggtaaaattaccaacataacaactgactcaaggtgtcctacccagggggaagcgactttacctgaggagcaggaccagaactacgtgtgtaagcacacatacgtggatagaggttggggaaacggttgtggtttgtttggaaaaggaagcttggtgacatgcgcaaaatttcaatgtttagaaccaatagagggaaaagtggtgcaacatgagagcctcaaatacacggtcaccattacagtgcacacaggagacgaacaccaggtgggcaatgacacgcagggagtcacggttgagatcacaccccaggcatcaaccgttgaagctgtcttgcctgaatatggaacccttgggctagaatgttcaccacgcacaggtttggatttcaatgaaatgattctattgacaatgaagaacaaagcatggatggtacataggcaatggttctttgacctacccctaccatggacatcaggagccacaacagaaacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatctttgcagggcacttgaaatgtagactcaagatggacaaattggaactcaaggggatgagctatgcaatgtgcttgaatacctttgtgttgaagaaagaagtctctgaaacgcagcatgggacaatactcattaaagttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgatcggaattggagacaaagccttgaaaattaactggtacaagaaaggaagctcgatcgggaagatgttcgaggccactgccagaggtgcaaggcgcatggctatcttgggagacacagcctgggactttggatcagtgggtggtgttctaaattcattagggaaaatggtgcaccaaatattcggaagtgcttacacagccctgtttggtggagtctcatggataatgaaaattggaataggtgtcctcttaacctggatagggttgaattcaaaaaacacttccatgtcattttcatgcattgtgataggaattattacactctatctaggaactgtggtacaagctgacatggggtgtgtcataaactggaaaggaaaagaactcaaatgtggaagtggaatcttcgtcactaatgaggtccacacctggacagagcaatacaaatttcaagcagactcccctaaaagactggcgacagccattgcaggcgcttgggaaaatggagtctgcggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggtttggagtcttcacaaccaacatatggctgaaactccgagaggtgtacacccaaacatgtgaccataggctaatgtcggcagccatcaaagatgagagggctgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctggctggtcctatttcgcaacacaaccacaggcccggataccacacccaaacggcaggaccctggcacttgggaaaattggagctggacttcaactattgtgaaggaacaacagtagtcatcacagaagattgcgggacaagaggcccatcattgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagagggaaatttgggaaaaaacatatgattgcaggggttctcttcacgtttgtgctccttctctcagggcaaataacatggagagatatggcacacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgagacataccagttgtggacggcattaatctccctaacatgttcaaacacaattttcacgttgactgttgcctggagaacagccactctgattctggccggagtttcgcttttgccagtgtgccagtcttcgagcatgaggaaaacagattggctcccagtggctgtggcagctatgggagttccatccttaccactttttatcttcagcttgaaagatacactcaaaaggaggagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagcagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaccaacaaggaatttttggaaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagagacagccgcaatcttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgttcctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgattctggctggaccaatgccagtcaccgcagcgagcgctgcgcaaaggagagggagagtcggcaggaacccacaaaaagaaaatgaccagtacatattcacgggccagcccctcaacaatgacgaagaccatgctcactggacagaagcaaaaatgctgctagacaacatcaacacaccagaagggattataccagctctctttgaaccagaaagggagaagtcagccgctatagacggtgaataccgcctgaagggtgagtccagaaagaccttcgtggaacttatgaggaggggtcacctcccagtttggctagcccataaagtagcatcagaagggatcaaatacacagatagaaaatggtgctttgatggagaacgcaataatcaaattttagaggagaacatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtcgggcctataggcatgcagtggaggaactaccagaaacaatggaaacactcctactcttgggactcatgatcctgttaacaggtggagcgatgcttttcctgatatcaggtagagggattggaaaggcttcaatagggctcatttgtgttattgtttccagtggcatgttatggatggccgatgtcccgcttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcacagcggtggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactaggacaggttatgcttctggtcctgtgtgcagttcaacttctgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctgggcttgccttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtctagaggaagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatatggatggaacatagttaagttaatgagtggaaaggatgtgttttatcttccacctgaaaagtgtgacaccctattgtgtgacattggagaatcttcaccaagcccaacagtagaagaaagcagaactataagagttttgaagatggttgaaccatggctaaaaaacaaccagttctgcataaaagtattaaacccttacatgccaactgtgattgaacacctagaaagactgcaaagaaaatatggaggaatgcttgtgagaaacccactctcacgaaactccacgcacgaaatgtactggatatccaatggtaccggcaacatcgtctcttcagtcaacatggtatccagattgctactgaacagattcacaatgacacacagaagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggagtggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggcaaagcaaaaggcagtagagctatatggtatatgtggttgggagccaggtaccttgagttcgaagcactcggatttttaaatgaagaccactggttctcgcgtgaaaactcttacagtggagtagaaggagaaggactgcacaagttgggatacatcttaagagatatctccaagatacctggaggagctatgtatgctgatgacacagctggttgggacacaagaataacagaagatgacctacacattgaggaaaaaatcacacagcaaatggaccctgaacacagacaattggcaaacgccatattcaagctcacgtaccaaaataaattggttaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgccagagaagaaaatcacacaatggttggaaaccgaaggagtggagagattaaagagaatggccatcagcggggatgattgcgtggtgaaaccgatcgatgacaggtttgccaatgccctgtttgccctgaacgatatgggaaaggtaaggaaggacatacctcaatggcagccatcaaagggctggcatgattggcaacaggttcctttctgctcccatcattttcatgaactgatcatgaaagatggaagaaagttggtggttccctgcagaccccaggacgaactaataggaagagcgaggatctctcaaggagcaggatggagcctcaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagaggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcaatgaagagtttctggactacatgccttcgatgaagagattcaggaaggaggaggagtcagagggagccatttggtaa

SEQ ID NO: 1319 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgagattggttatggcgttcatagctttcctcagattcctagccattccaccgacagcaggagtcttggctagatggggtaccttcaagaagtcgggggcgattaaggtcctgagaggcttcaagaaggagatctcaaacatgctgagcatcatcaacagacgaaaaaagacatcgttctgtctcatgatgatgttaccagcaacacttgccttccacttgacttcacgagatggagagccgcgcatgattgtggggaagaatgaaagaggaaaatccctactttttaagacagcctctggaattaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgtaatcaggctggagagcatagacgcgataagagatcggtggcgctagctccccatgtcggcatgggactggacacacgcacccaaacctggatgtcggctgaaggagcttggagacaagtcgagaaggtagagacatgggcttttaggcacccagggttcacaatactagccctatttcttgcccattacataggcacttccttgacccagaaagtggtaatctttatattactaatgctggtcaccccatccatggcaatgaggtgtgtgggagtaggaaacagagattttgtggaaggcctatcaggagctacgtgggttgacgtggtgctcgagcacggtgggtgtgtgactaccatggctaagaacaagcccacgctggatatagagctccagaagaccgaggccacccaactggcgaccctaagaaaactatgcattgagggaaaaattaccaacgtaacaaccgactcaaggtgccccacccaaggggaagcgattttacctgaggagcaggaccaaaactacgtgtgtaagcacacatacgtggacagaggctggggaaacggttgtggtttgtttggcaagggaagcttggtaacatgcgcgaaatttcaatgtttggaatcaatagagggaaaagtggtgcagcatgagaacctcaaatacaccgttatcatcacagtgcacacaggagaccaacaccaggtgggaaatgaaacgcagggggtcacggctgagataacaccacaggcatcaaccgttgaagccatcttacctgaatatggaacccttgggctagaatgctcaccacggacaggtttagatttcaatgaaatgatcttgttgacaatgaagaacaaagcttggatggtacatagacaatggttttttgacctacctttaccatggacatcaggggctacaacagaaacaccaacctggaacaagaaagagcttcttgtgacattcaaaaacgcacatgcaaaaaaacaagaagtagtggtccttggatcgcaagagggagcaatgcacacagcactgacaggagccacagagatccaaacctcaggaggcacaagcatctttgcggggcacttaaaatgcagactcaagatggacaaattggaactcaaggggatgagctatgcaatgtgcttgaatacctttgtgttgaagaaagaagtctccgaaacgcaacatgggacaatactcattaaggttgagtacaaaggggaagatgcaccctgcaagattcctttttccacggaggatggacaagggaaagctcacaatggcagactaatcacagctaacccagtggtgaccaagaaggaggagcccgtcaatattgaggctgaacctccttttggggaaagcaacatagtgattggaattggagacaaagctttgaaaatcaactggtacaagaagggaagctcgattgggaagatgttcgaggccactgccagaggtgcaaggcgcatggccatcttgggagatacagcctgggactttggatcagtgggtggtgttttaaattcattaggaaaaatggtgcatcaaatatttggaagtgcttatacggccctatttagtggagtctcctggataatgaaaattggaataggtgtcctcttaacctggatagggttgaactcaaaaaacacttccatgtcattctcatgcattgtgataggaatcattacactctatctaggaaccgtggtacaagctgacatggggtgtgtcataaactggaaaggcaaagaactcaaatgtggaagtggaattttcgtcactaatgaggtccacacctggacagagcaatacaaatttcaagcagactcccccaaaagactggcgacagccattgcaggcgcttgggagaatggagtgtgcggaatcaggtcaacaaccagaatggagaacctcttgtggaagcaaatagccaatgaactgaactacatattatgggaaaacaacatcaaattaacggtagttgtgggtgacataactggtgtcttagagcaagggaaaagaacactaacaccacaacccatggagctaaaatattcatggaaaacatggggaaaggcaaaaatagtgacagctgaaacacaaaattcctctttcataatagatgggccaaacacaccagagtgtccaagtgcctcaagagcatggaatgtgtgggaggtggaagattacgggttcggagtcttcacaaccaacatatggctaaaactccgagagatgtacacccaactatgtgaccacaggctaatgtcggcagccgtcaaggatgagagggccgtacacgccgacatgggctattggatagaaagccaaaagaatggaagctggaagctagaaaaggcatccctcatagaggtgaaaacctgcacatggccaaaatcacacactctttggagcaatggtgtgctagagagtgacatgatcatcccaaagagtctggctggtcctatttcgcaacacaaccacaggcccggataccatacccaaacggcaggaccctggcacttaggaaaattggagctggactttaactattgtgaaggaacaacagttgtcatcacagaaaactgtgggacaagaggcccatcactgaggacaacaacagtgtcagggaagttgatacacgaatggtgttgccgctcgtgcacacttcctcccctgcgatacatgggagaggacggctgctggtatggcatggaaattagacccattaatgagaaagaagagaacatggtaaagtctttagtctcagcagggagtggaaaggtggacaacttcacaatgggtgtcctgtgtttggcaatcctctttgaggaagtgatgagaggaaaatttgggaaaaaacacatgattgcaggggttctcttcacgtttgtgctccttctctcagggcaaataacatggagagatatggcacacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgaaacataccaactgtggacggcattaatctccctaacatgttcaaacacaattttcacgttgactgttgcctggagaacagccactctgattctggccggagtttcgcttttgccagtgtgccagtcttcgagcatgaggaaaacagattggctcccagtggctgtggcagctatgggagttccatccttaccactttttatcttcagcttgaaagatacactcaaaaggagaagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagcagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaccaacaaggaatttttggaaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaaaggagaggaggtgcaggttatcgccgtagagcctgggaagaacccaaagaactttcaaaccatgccaggcatttttcagacaacaacaggggaaataggagcgattgcactggacttcaagcctggaacctcaggatcccccatcataaacagagagggaaaggtagtgggactgtatggcaatggagtggttacaaagaatggtggctatgttagtggaatagcacaaacaaatgcagaaccagacggaccgacaccagagttggaagaagagatgttcaaaaagcgaaatctaactataatggatctccatcccgggtcaggaaagacacggaaataccttccaactattgtcagagaggcaatcaagagacgcttaaggactctgattttggcgccaacaagggtggttgcagctgagatggaagaagcattgaaagggctcccaataaggtatcaaacaactgcaacgaaatctgaacatacagggagagagattgttgatctaatgtgccacgcaacgttcacaatgcgcttgctgtcaccagtcagagttccaaactacaacttgataataatggatgaggctcatttcacagacccagccagtatagcggctagagggtacatatcaactcgtgtaggaatgggagaggcagccgcaattttcatgacagccacaccccctggaacagctgatgcctttcctcagagcaacgctccaattcaagatgaagaaagggacataccagaacgctcatggaattcaggcaatgaatggattaccgactttgttgggaagacggtgtggtttgtccctagcatcaaagctgggaatgacatagcaaactgcttgcggaaaaacggaaaaaaggtcattcaacttagtaggaagacttttgacacagaatatcaaaagaccaaactgaatgattgggacttcgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcgcagaggagagggagggtcggcaggaacccacaaaaggaaaatgaccaatacatattcacgggccagcccctcaataatgatgaagaccatgctcactggacagaagcaaaaatgctgctagataacatcaacacaccagaagggattataccagctctctttgaaccagaaagggagaagtcagccgccatagatggcgaataccgcctgaaaggtgagtccaggaagaccttcgtggaactcatgaggaggggtgacctcccagtttggctagcccataaagtagcatcagaagggatcaaatacacagatagaaaatggtgctttgatggagaacgcaataatcaaattttagaggagaacatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtcgggcctataggcatgcagtggaggaactaccagaaacaatggaaacactcctactcttgggactcatgatcctgttaacaggtggagcaatgcttttcctgatatcaggtaaagggattggaaaggcttcaatagggctcatttgtgttattgtttccagtggcatgttatggatggccgatgtcccacttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcacagcggtggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactaggacaggttatgcttctggtcctgtgtgcagttcaacttctgttaatgagaacatcatgggccttgtgtgaagctctaaccctagccacaggaccaataacaacactctgggaaggatcacctgggaagttttggaacaccacgatagctgtttccatggcgaacatctttagagggagctatttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatccgggatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagtcacagaagtgcgaggatacacaaaaggtggcccaggacatgaagaaccagtacctatgtctacatacggatggaacatagtcaagttaatgagtggaaaggatgtgttttatctcccacctgaaaagtgtgacactctattgtgtgacattggagaatcttcaccaagcccaacagtggaagaaagcagaaccataagagtcttgaagatggttgaaccatggctaaaaaataaccagttttgcattaaagtattgaacccttacatgccaactgtaattgagcacctagaaagactacaaagaaaacatggaggaatgcttgtgagaaatccactctcacgaaactccacgcacgaaatgtactggatatccaatggtaccggcaacatcgtctcttcagtcaacatggtatccagattgctactgaacagattcacaatgacacacagaagacccaccatagagaaagatgtggatttaggagcggggacccgacacgtcaatgcggaaccagaaacacccaacatggatgtcattggggaaagaataagaagaatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaaccccattcggccagcaaagggtttttaaagagaaagtggacaccaggacacccagacctatgccaggaacaagaaaggttatggagatcacagcggaatggctttggagaaccctaggaaggaataaaagacccagactatgcacgagagaggagttcacaaaaaaggtcagaaccaacgcagctatgggcgccgttttcacagaggagaaccaatgggatagtgctagagctgctgttgaagacgaagaattctggaaacttgtggacagagaacgtgaactccacaaattgggcaagtgtggaagctgcgtctacaacatgatgggtaagagagagaagaaacttggagagtttggcaaagcaaaaggcagtagagctatatggtatatgtggttgggagccaggtaccttgagttcgaagcactcggatttttaaatgaagaccactggttctcgcgtgaaaactcttacagtggagtagaaggagaaggactgcacaagttgggatacatcttgagagatatttccaagatacccggaggagccatgtatgctgatgacacagctggttgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggtagtggacaggtgggaacttatggcttgaatacatttaccaacatggaagcccagttaatcagacaaatggaaggagaaggtgtgttgtcgaaggcagacctcgagaaccctcatctgccagagaagaaaattacacaatggttagaaaccaaaggagtagagaggttaaaaagaatggccatcagcggggatgattgtgtggtgaaaccaatcgatgacaggttcgccaatgccctgcttgccctgaatgacatgggaaaagttaggaaggacatacctcaatggcagccatcgaagggatggcatgattggcaacaggtccctttctgctcccaccactttcatgaattgatcatgaaagatgggagaaagttggtagttccctgcagaccccaggatgaactaatagggagagcgaggatctctcaaggagcaggatggagcctcaaagaaactgcatgtctagggaaagcctacgctcaaatgtggagtctcatgtattttcacagaagagatcttagactggcatccaacgccatttgctcagcagtaccagcccattgggtccccacaagcagaacgacatggtctattcacgctcaccatcagaggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 1320 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccgacagcaggagtcttggctagatggggaacctttaagaagtcgggggctattaaggtcctgagaggcttcaagaaagagatctcaaacatgctgagcattatcaacagacggaaaaagacatcgttctgtctcatgatgatgttaccagccacacttgctttccacttgacttcacgagatggagagccgcgcatgattgtgggaaagaatgaaagagggaaatccctactttttaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcatagacgcgataagagatcggtggcgttagctccccatgtcggcatgggactggacacacgcacccaaacctggatgtcggctgaaggagcttggagacaagttgagaaggtagagacatgggcttttaggcacccagggttcacaatactagccctatttcttgcccattacataggcacttccttgacccagaaagtggttatttttatactactaatgctggtcaccccatccatgacaatgagatgtgtgggagtaggaaacagagattttgtggaaggcctatcaggagctacgtgggttgacgtggtgctcgagcacggtgggtgtgtgactaccatggctaagaacaagcccacgctggatatagagctccagaagaccgaggccacccaactggcgaccctaaggaaactatgcattgagggaaaaattaccaacgtaacaaccgactcaaggtgccccacccaaggggaagcgattttaccagaggagcaggaccagaactacgtgtgtaagcacacatacgtggacagaggctggggaaacggttgtggtttgtttggcaagggaagcttggttacatgcgctaaatttcaatgcttggaatcaatagagggaaaagtggtgcagcatgagaacctcaaatacaccgtcatcatcacagtgcacacaggagaccaacaccaggtgggaaatgaaacgcagggggtcacggctgagataacaccacaggcatcaaccgttgaagccatcttacctgaatatggaacccttgggctagaatgctcaccacggacaggtttagatttcaatgaaatgatcttgttgacaatgaagaacaaagcttggatggtacatagacaatggttttttgacctacctttaccatggacatcaggggctacaacagaaacaccaacctggaacaagaaagagcttcttgtgacattcaaaaacgcacatgcaaaaaaacaagaagtagtggtccttggatcgcaagagggagcaatgcacacagcactgacaggagccacagagatccaaacctcaggaggcacaagcatctttgcggggcacttaaaatgcagactcaagatggacaaattggaactcaaggggatgagctatgcaatgtgcttgaatgcctttgtgttgaagaaagaagtctccgaaacgcagcatgggacaatactcattaaggttgagtacaaaggggaaaatgcaccttgtaagattcctttctccacggaggatggacaagggaaagcccacaatggcagactgatcacagctaacccagtggtgaccaagaaggaggagcctgtcaacattgaggctgaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtgggtggtgttttaaattcattaggaaaaatggtgcaccaaatatttggaagtgcttacacagccctatttagtggagtctcctggataatgaaaattggaataggtgtcctcttaacctggatagggttgaattcaaaaaacacttccatgtcattttcatgcattgtgataggaatcattacactctatctgggggttgtggtacaagctgacatggggtgtgtcataaactggaaaggaaaagaactcaaatgtggaagtggaatcttcgtcactaatgaggtccacacctggacagagcaatacaaatttcaagcagactcccccaaaagactggcgacagccattgcaggcgcttgggaaaatggagtctgcggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggttcggagtcttcacaaccaacatatggctgaaactccgagaggtgtacacccaaacatgtgaccataggctaatgtcggcagccatcaaagatgagagggccgtgcacgccgacatgggctattggatagaaagccaaaagaatggaagttggaagctagaaaaagcatccttcatagaggtgaaaacctgtacatggccaaaatcacacactctttggagcaatggtgtgctagagagtgacatgatcatcccaaagagtctggctggtcctatttcgcaacacaaccacaggcccggataccacacccaaacggcaggaccctggcacttaggaaaattggagctggacttcaactattgtgaaggaacaacagtagtcatcacagaagattgcgggacaagaggcccatcattgagaacaacaacagtgtcagggaagttgatacacgaatggtgttgccgctcgtgcacactccctcccttgcgatacatgggagaggacggctgctggtatggcatggaaattagacccattaatgagaaagaagagaacatggtaaagtctttagtctcagcagggagtggaaaggtggacaacttcacaatgggtgtcctgtgtttggcaatcctcttcgaagaggtgatgagagggaaatttgggaaaaaacatatgattgcaggggttctcttcacgtttgtgctccttctctcagggcaaataacatggagagatatggcacacacattcataatgattgggtccaacgcttctgacaggatgggaatgggcgttacctacctagctttaattgcaacatttaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgaaacataccaactgtggacggcattaatctccctaacatgttcaaacacaattttcacgttgactgttgcctggagaacagccactctgattctggccggagtttcgcttttgccagtgtgccagtcttcgagcatgaggaaaacagattggctcccagtggctgtggcagctatgggagttccatccttaccactttttattttcagtctgaaagatacactcaaaaggagaagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagcagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaccaacaaggaatttttggaaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccaggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagggtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagacccagccagtatagcggctagagggtacatatcaactcgtgtaggaatgggagagacagccgcaattttcatgacagcaacaccccctggaacagctgaagcctttcctcagagcaacgctccaattcaagatgaagaaagggacataccggaacgctcatggaattcaggcaatgaatggattaccgactttgttgggaagacggtgtggtttgtccctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgatcctggctggaccaatgccagtcaccgcagcgagcgctgcgcaaaggagagggagagtcggcaggaacccacaaaaagaaaatgaccagtacatattcacgggccagcccctcaacaatgatgaagaccatgctcactggacagaagcaaaaatgctgctagacaacatcaacacaccagaagggattataccagctctctttgaaccagaaagggagaagtcagccgccatagacggcgaataccgcctgaagggtgagtccagaaagaccttcgtggaactcatgaggaggggtcacctcccagtttggctagcccataaagtagcatcagaagggatcaaatatacagatagaaaatggtgctttgatggagaacgcaataatcaaattttagaggagaatatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtcgggcctataggcatgcagtggaggaactaccagaaacaatggaaacactcctactcttgggactcatgatcctgttaacaggtggagcgatgcttttcctgatatcaggtagagggattggaaagacttcaatagggctcatttgtgttattgtttccagtggcatgttatggatggccgatgtcccgcttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcacagcggtggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactaggacaggttatgcttctggtcctgtgtgcagttcaacttctgttaatgagaacatcatgggccttgtgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacggggtcacaaggcgaaaccttgggggaaaagtggaaaaagaaattgaatcaattatcccggaaagagtttgacctttacaagaaatccgggatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagtcacagaagtgcgaggatacacaaaaggtggcccaggacatgaagaaccagtacctatgtctacatacggatggaacatagtcaagttaatgagtggaaaggatgtgttttatctcccacctgaaaagtgtgacactctattgtgtgacattggagaatcttcaccaagcccaacagtggaagaaagcagaaccataagagtcttgaagatggttgaaccatggctaaaaaacaaccagttttgcattaaagtactgaacccttacatgccaactgtaattgagcacctagaaagactacaaaggaaacatggaggaatgcttgtgagaaatccactctcacgaaactccacgcacgaaatgtactggatatccaatggtaccggcaacatcgtctcttcagtcaacatggtatccagattgctactgaacagattcacaatgacacacagaagacccaccatagagaaagatgtggatctgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggagtggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggcaaagcaaaaggcagtagagctatatggtatatgtggttgggagccaggtaccttgagttcgaagcactcggatttttaaatgaagaccactggttctcgcgtgaaaactcttacagtggagtagaaggagaaggactgcacaagttgggatacatcttgagagatatttccaagatacccggaggagccatgtatgctgatgacacagctggttgggacacaagaataacagaagatgacctgcataatgaggaaaaaatcacacagcaaatggaccctgaacacaggcagttagcaaacgctatattcaagctcacataccaaaacaaagtggtcaaagttcaacgaccaactccaaagggcacagtaatggacattatatctaggaaagaccaaagaggcagtggacaggtgggaacttatggtctgaatactttcaccaacatggaagctcagttaattagacagatggaaggagaaggtgtgttgtcgaaggcagacctcgagaaccctcatctgctagagaagaaaatcacacaatggttggaaactaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaagggatggcatgattggcaacaggtccctttctgctcccaccactttcatgaattgatcatgaaagatgggagaaagttggtagttccctgcagaccccaggacgaactaatagggagagcgaggatctctcaaggagcaggatggagcctcaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagaggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 1321 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccaacagcaggagtcttggctagatggggaaccttcaagaagtcaggggctattaaggtcctaaaaggcttcaagaaggagatttcaaacatgctgagcatcatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacttacaaatgccccttcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttgtactactaatgctggtcactccatccatggctatgagatgcgtgggagtaggaaacagagattttgtggaaggtctgtcgggagcaacgtgggttgatgtggtgctcgagcacggtgggtgtgtgaccaccatggctaagaacaagcctacgctggacatagagcttcagaagaccgaggccacccaactggcgaccctacggaagttatgcattgagggtaaaattaccaacataacaactgactcaaggtgtcctacccagggggaagcgactttacctgaggagcaggaccagaactacgtgtgtaagcacacatacgtggatagaggttggggaaacggttgtggtttgtttggaaaaggaagcttggtgacatgcgcaaaatttcaatgtttagaaccaatagagggaaaagtggtgcaacatgagaacctcaaatacactgtcaccattacagtgcacacaggagaccaacaccaggtgggaaatgacacgcagggagtcacggttgagataacaccccaggcatcaaccgttgaagctgtcttgcctgaatatggaacccttgggctagaatgttcaccacgcacaggtttggatttcaatgaaatgattctattgacaatgaagaacaaagcatggatggtacataggcaatggttctttgacctacccctaccatggacatcaggagccacaacagaaacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatctttgcagggcacttgaaatgtagactcaagatggacaaattggaactcaaggggatgagctatgcaatgtgcttgaatacctttgtgttgaagaaagaagtctctgaaacgcagcatgggacaatactcattaaagttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgatcggaattggagacaaagccttgaaaattaactggtacaagaaaggaagctcgatcgggaagatgttcgaggccactgccagaggtgcaaggcgcatggctatcttgggagacacagcctgggactttggatcagtgggtggtgttctaaattcattagggaaaatggtgcaccaaatattcggaagtgcttacacagccctgtttggtggagtctcatggataatgaaaattggaataggtgtcctcttaacctggatagggttgaattcaaaaaacacttccatgtcattttcatgcattgtgataggaattattacactctatctaggaactgtggtacaagctgacatggggtgtgtcataaactggaaaggaaaagaactcaaatgtggaagtggaatcttcgtcaccaatgaggtccacacctggacagagcaatacaaatttcaagcagactcccccaaaagactggcgacagccattgcaggtgcttgggagaatggagtgtgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggtttggagtcttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctggctggtcctatttcgcaacacaaccacaggcccggataccacacccaaacggcaggaccctggcacttgggaaaattggagctggacttcaactattgtgaaggaacaacagtagtcatcacagaagactgcgggacaagaggcccatcattgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagagggaaatttgggaaaaaacatatgattgcaggggttctcttcacgtttgtgctccttctctcagggcaaataacatggagagatatggcaaacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgagacataccagttgtggacggcattaatctccctaacatgttcaaacacaattttcacgttgactgttgcctggagaacagccaccttgattctggccggagtttcgcttttgccagtgtgccagtcttcgagcatgaggaaaacagattggctcccagtggctgtggcagctatgggagttccatccttaccactttttattttcagtttgaaagatacactcaaaaggaggagctggccactgaatgagggggtgatggccattggacttgtgagcattctggctagttctctccttaggaatgacgtgcccatggctggaccattagtggctgggggcttgctgatagcgtgctatgtcataactggcacgtcagcagacctcactgtagaaaaagcagcagatgtaacatgggaggaagaggctgagcaaacaggagtgtcccataatttaatgatcacagttgatgatgatggaacaatgagaataaaagatgatgagactgagaacatcttaacagtgcttttgaaaacagcattactaatagtatcaggcatctttccgtactccatacccgcaacactgctggtctggcacacttggcaaaagcaaacccaaagatccggcgtcctatgggacgtacccagccccccagagactcagaaggcagaactggaagaaggggtctataggatcaagcagcaaggaatttttggaaaaacccaagtgggggttggaatacaaaaagaaggagttttccacaccatgtggcacgttacaagaggagcagtgttgacacacaatgggaaaagactggaaccaaactgggccagcgtgaaaaaagacctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagagacagccgcaatcttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgttcctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgattctggctggaccaatgccagtcaccgcagcgagcgctgcgcaaaggagagggagagtcggcaggaaccccccaaaagaaaatgaccagtacatattcacgggccagcccctcaacaatgacgaagaccatgctcactggacagaagcaaaaatgctgctagacaacatcaacacaccagaagggattataccagctctctttgaaccagaaagggagaagtcagccgctatagacggtgaataccgcctgaagggtgagtccagaaagaccttcgtggaacttatgaggaggggtgacctcccagtttggctagcccacaaagtagcatcagaagggatcaaatacacagatagaaaatggtgctttgatggagaacgcaataatcaaattttagaggagaacatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtagggcctataggcatgcagtggaggaactaccagaaacaatggaaacactcctactcttgggactcatgatcctgttaacaggtggagcaatgcttttcctgatatcaggtaaagggattggaaagacttcaataggactcatttgtgttattgtttccagtggcatgttatggatggccgatgtcccgcttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggatattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcatagcggcggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactaggacaggttatgcttctggtcctgtgtgcagttcaacttctgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctgggcttgccttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtctagaggaagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatatggatggaacatagttaagttaatgagtggaaaggatgtgttttatcttccacctgaaaagtgtgacaccctattgtgtgacattggagaatcttcaccaagcccaacagtagaagaaagcagaactataagagttttgaagatggttgaaccatggctaaaaaacaaccagttctgcataaaagtattaaacccttacatgccaactgtgattgaacacctagaaagactgcaaagaaaatatggaggaatgcttgtgagaaacccactctcacgaaactccacgcacgaaatgtactggatatccaatggtaccggcaacatcgtctcttcagtcaacatggtatccagattgctactgaacagattcacaatgacacacagaaaacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggtaaagcaaaaggcagtagggctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatctccaagatacctggaggagctatgtatgctgatgacacagctggttgggacacaagaataacagaagatgacctacacaatgaggaaaaaatcacacagcaaatggaccctgaacacagacaattggcgaacgccatattcaagctcacgtaccaaaataaagtggttaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgccagagaagaaaatcacacaatggttggaaaccgaaggagtggagagattaaagagaatggccatcagcggggatgattgcgtggtgaaaccgatcgatgacaggtttgccaatgccctgtttgccctgaacgatatgggaaaggttaggaaggacatacctcaatggcagccatcaaagggctggcatgattggcaacaggtccctttctgctcccatcattttcatgaactgatcatgaaagatggaagaaagttggtggttccctgcagaccccaggacgaactaataggaagagcgaggatctctcaaggagcaggatggagccttaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcaatgaagagtttctggactacatgccttcgatgaagagattcaggaaggaggaggagtcagagggagccatttggtaa

SEQ ID NO: 1322 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccaacagcaggagtcttggctagatggggaaccttcaagaagtcaggggctattaaggtcctaaaaggcttcaagaaggagatttcaaacatgctgagcatcatcaacaaaaggaaaaagacatcgttctgtctcatgatgatgttaccagcaacacttgctttccacttgacttcacgcgatggagagcctggcatgattgtcgggaagaatgaaagagggaaatccatattttttaagacagcttctggaatcaacatgtgcacactcatagccatggacttgggagagatgtgtgatgacacggtcacctacaaatgccccttcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttgtactactaatgctggtcactccatccatggctatgagatgcgtgggagtaggaaacagagattttgtggaaggtctgtcgggagcaacgtgggttgatgtggtgctcgagcacggtgggtgtgtgaccaccatggctaagaataagcctacgctggacatagagcttcagaagaccgaggccacccaactggcgaccctaaggaagttatgcattgagggtaaaattaccaacataacaactgactcaaggtgtcctacccagggggaagcgactttgcctgaggagcaggaccagaactacgtgtgtaagcacacatacgtggatagaggttggggaaacggttgtggtttgtttggaaaaggaagcttggtgacatgcgcaaaatttcaatgtttagaaccaatagagggaaaagtggtgcaacatgagaacctcaaatacactgtcaccattacagtgcacacaggagaccaacaccaggtgggaaatgacacgcagggagtcacggttgagataacaccccaggcatcaaccgttgaagctgtcttgcctgaatatggaacccttgggctagaatgttcaccacgcacaggtttggatttcaatgaaatgattctattgacaatgaagaacaaagcatggatggtacataggcaatggttctttgacctacccctaccatggacatcaggagccacaacagaaacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatctttgcagggcacttgaaatgtagactcaagatggacaaattggaactcaaggggatgagctatgcaatgtgcttgaacacctttgtgttgaagaaagaagtctctgaaacgcagcatgggacaatactcattaaagttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgatcggaattggagacaaagccttgaaaattaactggtacaagaaaggaagctcgatcgggaagatgttcgaggccactgccagaggtgcaaggcgcatggctatcttgggagacacagcctgggactttggatcagtgggtggtgttctaaattcattagggaaaatggtgcaccaaatattcggaagtgcttacacagccctgtttggtggagtctcatggataatgaaaattggaataggtgtcctcttaacctggatagggttgaattcaaaaaacacttccatgtcattttcatgcattgtgataggaattattacactctatctaggaactgtggtacaagctgacatggggtgtgtcataaactggaaaggaaaagaactcaaatgtggaagtggaatcttcgtcaccaatgaggtccacacctggacagagcaatacaaatttcaagcagactcccctaaaagactggcgacagccattgcaggcgcttgggaaaatggagtctgcggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggtttggagtcttcacaaccaacatatggctgaaactccgagaggtgtacacccaaacatgtgaccataggctaatgtcggcagccatcaaagatgagagggctgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctggctggtcctatttcgcaacacaaccacaggcccggataccacacccaaacggcaggaccctggcacttgggaaaattggagctggacttcaactattgtgaaggaacaacagtagtcatcacagaagactgcgggacaagaggcccatcattgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacgatgggagtcctgtgtttggcaatcctcttcgaagaggtgatgagagggaaatttgggaaaaaacatatgattgcaggggttctcttcacgtttgtgctccttctctcagggcaaataacatggagagatatggcacacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgagacataccagttgtggacggcattaatctccctaacatgttcaaacacaattttcacgttgactgttgcctggagaacagccaccttgattctggccggagtttcgcttttgccagtgtgccagtcttcgagcatgaggaaaacagattggctcccagtggctgtggcagctatgggagttccatccttaccactttttatcttcagcttgaaagatacactcaaaaggaggagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagtagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaacaacaaggaatttttggaaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtataccggctagagggtacatatcaactcgtgtaggaatgggagagacagccgcaatcttcatgacagcaacaccccctggaacaaccgaagcctttcctcagagcaacgctccaattcaagatgaagaaagggatattccggaacgctcatggaattcaggcaatgaatggattaccgactttgttgggaagacggtgtggtttgttcctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgattctggctggaccaatgccagtcaccgcagcgagcgctgcgcaaaggagagggagagtcggcaggaaccccccaaaagaaaatgaccagtacatattcacgggccagcccctcaacaatgacgaagaccatgctcactggacagaagcaaaaatgctgctagacaacatcaacacaccagaagggattataccagctctctttgaaccagaaagggagaagtcagccgctatagacggtgaataccgcctgaagggtgagtccagaaagaccttcgtggaacttatgaggaggggtgacctcccagtttggctagcccataaagtagcatcagaagggatcaaatacacagatagaaaatggtgctttgatggagaacgcaataatcaaattttagaggagaacatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtagggcctataggcatgcagtggaggaactaccagaaacaatggaaacactcctactcttgggactcatgatcctgttaacaggtggagcgatgcttttcctgatatcaggtagagggattggaaagacttcaataggactcatttgtgttattgtttccagtggcatgttatggatggccgatgtcccacttcaatggatcgcgtcggctatagtcctggaatttttcatgatggtgttgctcataccagaaccagaaaagcagagaactccccaggataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcatagcggcggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactaggacaggttatgcttctggtcctgtgtgcagttcaacttctgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctgggcttgccttttctatcatgaaatcagttggaacaggaaagagaggaacggggtcacaaggcgaaaccttaggagaaaagtggaaaaaagaattaaatcagttatcccggaaagagtttgacctttacaagaaatctggaatcactgaagtggatagaacagaagccaaagaagggttgaaaagaggagaaacaacacaccatgccgtgtctagaggaagtgcaaaacttcaatggttcgtggagaggaacatggtcattcccgaaggaagagtcatagacttaggctgtggaagaggaggctggtcatattactgcgcaggactgaaaaaagttatagaagtgcgaggatacacaaaaggcggcccaggacacgaagaaccagtacctatgtctacatatggatggaacatagttaagttaatgagtggaaaggatgtgttttatcttccacctgaaaagtgtgacaccctattgtgtgacattggagaatcttcaccaagcccaacagtagaagaaagcagaactataagagttttgaagatggttgaaccatggctaaaaaacaaccagttctgcataaaagtattaaacccttacatgccaactgtgattgaacacctagaaagactgcaaagaaaatatggaggaatgcttgtgagaaacccactctcacgaaactccacgcacgaaatgtactggatatccaatggtaccggcaacatcgtctcttcagtcaacatggtatccagattgctactgaacagattcacaatgacacacagaagacccaccatagagaaagatgtggatttgggagcaggaactcgacatgtcaatgcggaaccagaaacacccaacatggacgtcattggagaaagaataaaaaggatcaaggaggaacataattcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggtaaagcaaaaggcagtagggctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatctccaagatacctggaggagctatgtatgctgatgacacagctggttgggacacaagaataacagaagatgacctacacaatgaggaaaaaatcacacagcaaatggaccctgaacacagacaattggcgaacgccatattcaagctcacgtaccaaaataaagtggttaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgccagagaagaaaatcacacaatggttggaaaccgaaggagtggagagattaaagagaatggccatcagcggggatgattgcgtggtgaaaccgatcgatgacaggtttgccaatgccctgtttgccctgaacgatatgggaaaggtaaggaaggacatacctcaatggcagccatcaaagggctggcatgattggcaacaggtccctttctgctcccatcattttcatgaactgatcatgaaagatggaagaaagttggtggttccctgcagaccccgggacgaactaataggaagagcgaggatctctcaaggagcaggatggagcctcaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcaatgaagagtttctggactacatgccttcgatgaagagattcaggaaggaggaggagtcagagggagccatttggtaa

SEQ ID NO: 1323 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccaacagcaggagtcttggctagatggggaaccttcaagaagtcaggggctattaaggtcctaaaaggcttcaagaaggagatttcaaacatgctgagcatcatcaacaaaaggaaaaagacatcgttctgtctcatgatgatgttaccagcaacacttgctttccacttgacttcacgcgatggagagcctggcatgattgtcgggaagaatgaaagagggaaatccatattttttaagacagcttctggaatcaacatgtgcacactcatagccatggacttgggagagatgtgtgatgacacggtcacctacaaatgccccttcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttgtactactaatgctggtcactccatccatggctatgagatgcgtgggagtaggaaacagagattttgtggaaggtctgtcgggagcaacgtgggttgatgtggtgctcgagcacggtgggtgtgtgaccaccatggctaagaataagcctacgctggacatagagcttcagaagaccgaggccacccaactggcgaccctaaggaagttatgcattgagggtaaaattaccaacataacaactgactcaaggtgtcctacccagggggaagcgactttgcctgaggagcaggaccagaactacgtgtgtaagcacacatacgtggatagaggttggggaaacggttgtggtttgtttggaaaaggaagcttggtgacatgcgcaaaatttcaatgtttagaaccaatagagggaaaagtggtgcaacatgagaacctcaaatacactgtcaccattacagtgcacacaggagaccaacaccaggtgggaaatgacacgcagggagtcacggttgagataacaccccaggcatcaaccgttgaagctgtcttgcctgaatatggaacccttgggctagaatgttcaccacgcacaggtttggatttcaatgaaatgattctattgacaatgaagaacaaagcatggatggtacataggcaatggttctttgacctacccctaccatggacatcaggagccacaacagaaacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatctttgcagggcacttgaaatgtagactcaagatggacaaattggaactcaaggggatgagctatgcaatgtgcttgaatacctttgtgttgaagaaagaagtctctgaaacgcagcatgggacaatactcattaaagttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgatcggaattggagacaaagccttgaaaattaactggtacaagaaaggaagctcgatcgggaagatgttcgaggccactgccagaggtgcaaggcgcatggctatcttgggagacacagcctgggactttggatcagtgggtggtgttctaaattcattagggaaaatggtgcaccaaatattcggaagtgcttacacagccctgtttggtggagtctcatggataatgaaaattggaataggtgtcctcttaacctggatagggttgaattcaaaaaacacttccatgtcattttcatgcattgtgataggaattattacactctatctaggaactgtggtacaagctgacatggggtgtgtcataaactggaaaggaaaagaactcaaatgtggaagtggaatcttcgtcaccaatgaggtccacacctggacagagcaatacaaatttcaagcagactcccctaaaagactggcgacagccattgcaggcgcttgggaaaatggagtctgcggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggtttggagtcttcacaaccaacatatggctgaaactccgagaggtgtacacccaaacatgtgaccataggctaatgtcggcagccatcaaagatgagagggctgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctggctggtcctatttcgcaacacaaccacaggcccggataccacacccaaacggcaggaccctggcacttgggaaaattggagctggacttcaactattgtgaaggaacaacagtagtcatcacagaagactgcgggacaagaggcccatcattgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagagggaaatttgggaaaaaacatatgattgcaggggttctcttcacgtttgtgctccttctctcagggcaaataacatggagagatatggcacacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgagacataccagttgtggacggcattaatctccctaacatgttcaaacacaattttcacgttgactgttgcctggagaacagccaccttgattctggccggagtttcgcttttgccagtgtgccagtcttcgagcatgaggaaaacagattggctcccagtggctgtggcagctatgggagttccatccttaccactttttatcttcagcttgaaagatacactcaaaaggaggagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagtagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaacaacaaggaatttttggaaaaacccaagtgggggttggagtacagaaagaaggagtcttccacaccatgtggcacgtcacaagaggggcagtgttgacgcacaatgggaaaagactggaaccaaactgggccagtgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagagacagccgcaatcttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgttcctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgattctggctggaccaatgccagtcaccgcagcgagcgctgcgcaaaggagagggagagtcggcaggaaccccccaaaagaaaatgaccagtacatattcacgggccagcccctcaacaatgacgaagaccatgctcactggacagaagcaaaaatgctgctagacaacatcaacacaccagaagggattataccagctctctttgaaccagaaagggagaagtcagccgctatagacggtgaataccgcctgaagggtgagtccagaaagaccttcgtggaacttatgaggaggggtgacctcccagtttggctagcccacaaagtagcatcagaagggatcaaatacacagatagaaaatggtgctttgatggagaacgcaataatcaaattttagaggagaacatggatgtggaaatctggacaaaggaaggagaaaggaaaaaattaagacctaggtggcttgatgcccgcacttattcagatcccttagcactcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtagggcctataggcatgcagtggaggaactaccagaaacaatggaaacactcctactcttgggactcatgatcctgttaacaggtggagcaatgcttttcctgatatcaggtaaagggattggaaagacttcaataggactcatttgtgttattgtttccagtggcatgttatggatggccgatgtcccacttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcacagcggcggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactaggacaggttatgcttctggtcctgtgtgcagttcaacttctgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctgggcttgccttttctatcatgaaatcagttggaacaggaaagagaggaacggggtcacaaggcgaaaccttaggagaaaagtggaaaaaagaattaaatcagttatcccggaaagagtttgacctttacaagaaatctggaatcactgaagtggatagaacagaagccaaagaagggttgaaaagaggagaaacaacacaccatgccgtgtctagaggaagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatatggatggaacatagttaagttaatgagtggaaaggatgtgttttatcttccacctgaaaagtgtgacaccctattgtgtgacattggagaatcttcaccaagcccaacagtagaagaaagcagaactataagagttttgaagatggttgaaccatggctaaaaaacaaccagttctgcataaaagtattaaacccttacatgccaactgtgattgaacacctagaaagactgcaaagaaaatatggaggaatgcttgtgagaaacccactctcacgaaactccacgcacgaaatgtactggatatccaatggtaccggcaacatcgtctcttcagtcaacatggtatccagattgctactgaacagattcacaatgacacacagaagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggtaaagcaaaaggcagtagggctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatctccaagatacctggaggagctatgtatgctgatgacacagctggttgggacacaagaataacagaagatgacctacacaatgaggaaaaaatcacacagcaaatggaccctgaacacagacaattggcgaacgccatattcaagctcacgtaccaaaataaagtggttaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgccagagaagaaaatcacacaatggttggaaaccgaaggagtggagagattaaagagaatggccatcagcggggatgattgcgtggtgaaaccgatcgatgacaggtttgccaatgccctgtttgccctgaacgatatgggaaaggttaggaaggacatacctcaatggcagccatcaaagggctggcatgattggcaacaggtccctttctgctcccatcattttcatgaactgatcatgaaagatggaagaaagttggtggttccctgcagaccccaggacgaactaataggaagagcgaggatctctcaaggagcaggatggagccttaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcaatgaagagtttctggactacatgccttcgatgaagagattcaggaaggaggaggagtcagagggagccatttggtaa

SEQ ID NO: 1324 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccatcccaccaacagcaggagtcttggctagatggggaaccttcaagaagtcaggggctattaaggtcctaaaaggcttcaagaaggagatttcaaacatgctgagcatcatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacctacaaatgccccttcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttgtactactaatgctggtcactccatccatggctatgagatgcgtgggagtaggaaacagagattttgtggaaggtctgtcgggagcaacgtgggttgatgtggtgctcgagcacggtgggtgtgtgaccaccatggctaagaataagcctacgctggacatagagcttcagaagaccgaggccacccaactggcgaccctaaggaagttatgcattgagggtaaaattaccaacataacaactgactcaaggtgtcctacccagggggaagcgactttacctgaggagcaggaccagaactacgtgtgtaagcacacatacgtggatagaggttggggaaacggttgtggtttgtttggaaaaggaagcttggtgacatgcgcaaaatttcaatgtttagaaccaatagagggaaaagtggtgcaacatgagaacctcaaatacactgtcaccattacagtgcacacaggagaccaacaccaggtgggaaatgacacgcagggagtcacggttgagataacaccccaggcatcaaccgttgaagctgtcttgcctgaatatggaacccttgggctagaatgttcaccacgcacaggtttggatttcaatgaaatgattctattgacaatgaagaacaaagcatggatggtacataggcaatggttctttgacctacccctaccatggacatcaggagccacaacagaaacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatctttgcagggcacttgaaatgtagactcaagatggacaaattggaactcaaggggatgagctatgcaatgtgcttgaatacctttgtgttgaagaaagaagtctctgaaacgcagcatgggacaatactcattaaagttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgatcggaattggagacaaagccttgaaaattaactggtacaagaaaggaagctcgatcgggaagatgttcgaggccactgccagaggtgcaaggcgcatggctatcttgggagacacagcctgggactttggatcagtgggtggtgttctaaattcattagggaaaatggtgcaccaaatattcggaagtgcttacacagccctgtttggtggagtctcatggataatgaaaattggaataggtgtcctcttaacctggatagggttgaattcaaaaaacacttccatgtcattttcatgcattgtgataggaattattacactctatctaggaactgtggtacaagctgacatggggtgtgtcataaactggaaaggaaaagaactcaaatgtggaagtggaatcttcgtcaccaatgaggtccacacctggacagagcaatacaaatttcaagcagactcccctaaaagactggcgacagccattgcaggcgcttgggaaaatggagtctgcggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgatagctgaaacacaaaattcctctttcataatagatgggccaaacacaccagagtgtccaagtgcttcaagagcatggaatgtgtgggaggtggaagattacgggtttggagtcttcacaaccaacatatggctgaaactccgagaggtgtacacccaaacatgtgaccataggctaatgtcggcagccatcaaagatgagagggctgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctggctggtcctatttcgcaacacaaccacaggcccggataccacacccaaacggcaggaccctggcacttgggaaaattggagctggacttcaactattgtgaaggaacaacagtagtcatcacagaagactgcgggacaagaggcccatcattgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagagggaaatttgggaaaaaacatatgattgcaggggttctcttcacgtttgtgctccttctctcagggcaaataacatggagagatatggcacacacattcataatgattgggtccaacgcttctgacaggatgggaatgggcgttacctacctagctttaattgcaacattcaaaattcagccattcttggctttgggattcttcctgaggaaattgacatccagagaaaatttgctgttgggagttgggttagccatggcaacaacgctacaactgccagaggacattgaacaaatggcgaatggaattgctctggggcttatggctctaaaactgataacacaatttgagacataccagttgtggacggcattaatctccctaacatgttcaaacacaattttcacgttgactgttgcctggagaacagccaccttgattctggccggagtttcgcttttgccagtgtgccagtcttcgagcatgaggaaaacagattggctcccagtggctgtggcagctatgggagttccatccttaccactttttatcttcagcttgaaagatacactcaaaaggaggagctggccactgaatgagggggtgatggctgttggccttgtgagcattctagctagttctctccttaggaatgatgtgcccatggctggaccactagtggctggaggcttgctgatagcatgctatgtcataactggcacgtcagcagacctcactgtagaaaaagcagcagatgtaacatgggaggaagaggctgagcaaacaggagtgtcccataatttgatgatcacagttgatgatgatggaacaatgagaataaaagatgatgagactgagaacatcctaacagtgctcttaaaaacagcattactaatagtatcaggcatctttccatactcaatacccgccacactgttggtctggcatacttggcaaaagcaaacccaaagatctggcgttctatgggacgtgcccagccccccagaaacacagaaagcagaactggaagagggggtctataggatcaaacaacaaggaatttttggaaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacctcaggatctcctatcataaacagagagggaaaggtagtgggactgtatggcaatggagtggttacaaaaaatggtggctacgttagtggaatagcgcaaacaaacgcagaaccagacggaccgacaccggaattggaagaagaaatgtttaaaaagcgaaatctaaccataatggatcttcatcctgggtcaggaaagacgcggaaatatcttccagccatcgtcagagaggcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagagacagccgcaatcttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgttcctagcatcaaagccggaaatgacatagcaaactgcttgcggaaaaacggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgattctggctggaccaatgccagtcaccgcagcgagcgctgcgcaaaggagagggagagtcggcaggaaccccccaaaagaaaatgaccagtacatattcacgggccagcccctcaacaatgacgaagaccatgctcactggacagaagcaaaaatgctgctagacaacatcaacacaccagaagggattataccagctctctttgaaccagaaagggagaagtcagccgctatagatggtgaatatcgcctgaaaggtgagtccaggaagaccttcgtggaactcatgaggaggggtgacctcccagtctggctagcccataaagtagcatcagaagggatcaaatacacagatagaaaatggtgttttgatggagaacgcaacaatcaaattttagaggagaatatggatgtggaaatctggacaaaggaaggagaaaagaaaaaattaagacctaggtggcttgatgcccgcacttattcagatcccttggcgctcaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcggtagggcctataggcatgcagtggaggaactaccagaaacaatggaaacactcctactcttgggactcatgatcctgttaacaggtggagcaatgcttttcctgatatcaggtaaagggattggaaagacttcaataggactcatttgtgttattgtttccagtggcatgttatggatggccgatgtcccacttcaatggatcgcgtcggctatagtcctggaatttttcatgatggtgttgctcataccagaaccagaaaagcagagaactccccaagataaccaactcgcatatgtcgtgataggcatactcacactagctgcgatagtagcagccaatgaaatgggactattggaaaccacaaagagagatttaggaatgtctaaagaaccaggtgttgtttctccaaccagttatttagatgtagacctgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactaggctgctattcacaagtgaacccactcactctcacagcggcggtacttctgctagttacacattatgccattataggtccaggattgcaggctaaagccactcgagaagctcaaaaaaggacagctgcaggaataatgaagaatccaacggtggacgggataatgacaatagacctagatcctgtaatatacgattcaaaatttgaaaagcaactaggacaggttatgcttctggtcctgtgtgcagttcaacttctgttaatgagaacatcatgggccttgtgtgaagctctaaccctagccacaggaccaataacaacactttgggaaggatcacctggaaagttttggaacaccacaatagctgtctccatggcgaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatccggaatcactgaagtggatagaacagaagccaaagaagggttgaaaagaggggaaacaacacaccatgccgtgtctagaggcagtgcaaaacttcaatggttcgtggagagaaacatggtcattcccgaaggaagagtcatagacttaggctgtggaagaggaggctggtcatattattgcgcaggactgaaaaaagttacagaagtgcgaggatacacaaaaggcggcccaggacatgaagaaccagtacccatgtctacatatggatggaacatagtcaagttaatgagtggaaaggatgtgttttatcttccacctgaaaagtgtgataccctattgtgtgacattggagaatcttcaccaagcccaacagtagaagaaagcagaactataagagttttgaagatggttgaaccatggctaaaaaacaaccagttctgcataaaagtattaaacccttacatgccaactgtgattgaacacctagaaagactgcaaagaaaatatggaggaatgcttgtgagaaacccactctcacgaaactccacgcacgaaatgtactggatatccaatggtaccggcaacatcgtctcttcagtcaacatggtatccagattgctactgaacagattcacaatgacacacagaagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggtaaagcaaaaggcagtagggctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatctccaagatacctggaggagctatgtatgctgatgacacagctggttgggacacaagaataacagaagatgacctacacaatgaggaaaaaatcacacagcaaatggaccctgaacacagacaattggcgaacgccatattcaagctcacgtaccaaaataaagtggttaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgccagagaagaaaatcacacaatggttggaaaccgaaggagtggagagattaaagagaatggccatcagcggggatgattgcgtggtgaaaccgatcgatgacaggtttgccaatgccctgtttgccctgaacgatatgggaaaggtaaggaaggacatacctcaatggcagccatcaaagggctggcatgattggcaacaggttcctttctgctcccatcattttcatgaactgatcatgaaagatggaagaaagttggtggttccctgcagaccccaggacgaactaataggaagagcgaggatctctcaaggagcaggatggagcctcaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 1325 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccgacagcaggagtcttggctagatggggaacctttaagaagtcgggggctattaaggtcctgagaggcttcaagaaagagatctcaaacatgctgagcattatcaacagacggaaaaagacatcgttctgtctcatgatgatgttaccagccacacttgctttccacttgacttcacgagatggagagccgcgcatgattgtgggaaagaatgaaagagggaaatccctactttttaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcatagacgcgataagagatcggtggcgttagctccccatgtcggcatgggactggacacacgcacccaaacctggatgtcggctgaaggagcttggagacaagttgagaaggtagagacatgggcttttaggcacccagggttcacaatactagccctatttcttgcccattacataggcacttccttgacccagaaagtggtcatttttatactactaatgctggtcaccccatccatgacaatgagatgtgtgggagtaggaaacagagattttgtggaaggcctatcaggagctacgtgggttgacgtggtgctcgagcacggtgggtgtgtgactaccatggctaagaacaagcccacgctggatatagagctccagaagaccgaggccacccaactggcgaccctaaggaaactatgcattgagggaaaaattaccaacgtaacaaccgactcaaggtgccccacccaaggggaagcgattttaccagaggagcaggaccagaactacgtgtgtaagcacacatacgtggacagaggctggggaaacggttgtggtttgtttggcaagggaagcttggtaacatgcgctaaatttcaatgcttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgttgaagccatcttacctgaatatggaacccttgggctagaatgctcaccacggacaggtttagattttaatgaaatgattttgttgacaatgaagaacaaagcatggatggtacatagacaatggttttttgacctacctctaccatggacatcaggagcaacaacagaaacaccaacctggaacaagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcgggacacttaaaatgtagactcaagatggacaaattggaactcaaggggatgagctatgcaatgtgcttgaatacctttgtgttgaagaaagaagtctccgaaacgcaacatgggacaatactcattaaggttgagtacaaaggggaagatgcaccttgtaagattcctttctccacggaggatggacaagggaaagcccacaatggcagactgatcacagctaacccagtggtgaccaagaaggaggagcctgtcaatattgaggcagaacctccttttggggaaagtaatatagtaattggaatcggagacaaagccttgaaaatcaactggtacaagaagggaagctcgattgggaagatgttcgaggccactgccagaggtgcaaggcgcatggccatcttgggagacacagcctgggactttggatcagtgggtggtgttttaaattcattaggaaaaatggtgcaccaaatatttggaagtgcttacacagccctatttagtggagtctcctggataatgaaaattggaataggtgtcctcttaacctggatagggttgaattcaaaaaacacttccatgtcattttcatgcattgtgataggaatcattacactctatctgggggtcgtggtacaagctgacatggggtgtgtcataaactggaaaggaaaagaactcaaatgtggaagtggaatcttcgtcaccaatgaggtccacacctggacagagcaatacaaatttcaagcagactcccccaaaagactggcgacagccattgcaggtgcttgggagaatggagtgtgcggaatcaggtcgacaaccagaatggagaatctattgtggaagcaaatagccaatgaactgaactacatattatgggaaaacaacatcaaattaacggtagttgtgggtgacataattggggtcttagagcaagggaaaagaacactaacaccacaacccatggagctaaaatattcatggaaaacatggggaaaggcaaaaatagtgacagctgaaacacaaaattcctctttcataatagatgggccaaacacaccagagtgtccaagtgcttcaagagcatggaatgtgtgggaggtggaagattacgggttcggagtcttcacaaccaacatatggctgaaactccgagagatgtacacccaactatgtgaccacaggctaatgtcggcagccatcaaggatgagagggccgtacacgccgacatgggctattggatagaaagccaaaagaatggaagttggaagctagaaaaggcatccctcatagaggtgaaaacctgcacatggccaaaatcacacactctttggagcaatggtgtgctagagagtgacatgatcatcccaaagagtctggctggtcctatttcgcaacacaaccacaggcccggataccacacccaaacggcaggaccctggcacttaggaaaattggagctggacttcaactattgtgaaggaacaacagttgtcatcacagaagactgcgggacaagaggcccatcactgaggacaacaacagtgtcagggaagttgatacacgaatggtgttgccgctcgtgcacacttcctcccttgcgatacatgggagaggacggctgctggtatggcatggaaattagacccgttaatgagaaagaagagaacatggtaaagtctttagtctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctccttctctcagggcaaataacatggagagatatggcacacacactcataatgattgggtccaacgcttctgacagaatgggaatgggcgttacctacctagcattgattgcgacatttaaaattcagccatttttggctttgggattcttcctgaggaaattgacatctagagaaaatttattgttgggagttgggttggccatggcaacaacgttacaactgccagaggacattgaacaaatggcgaatggaatagctctggggctcatggctcttaaattgataacacaatttgaaacataccaactatggacggcattagtctccctaatgtgttcaaacacaattttcacgttgactgttgcctggagaacagccactctgattttggccggagtttcgcttttgccagtgtgccagtcttcgagcatgaggaaaacagattggctcccaatggctgtggcagctatgggagttccacccttaccactttttattttcagtctgaaagatacactcaaaaggagaagctggccactgaatgagggggtgatggccattggacttgtgagcattctagctagttctctccttaggaatgacgtgcccatggctggaccattagtggctgggggcttgctgatagcgtgctatgtcataactggcacgtcagcagacctcactgtagaaaaagcagcagatgtaacatgggaggaagaggctgagcaaacaggagtgtcccataatttaatgatcacagttgatgatgatggaacaatgagaataaaagatgatgagactgagaacatcttaacagtgcttttgaaaacagcattactaatagtatcaggcatctttccgtactccatacccgcaacactgctggtctggcacacttggcaaaagcaaacccaaagatccggcgtcctatgggacgtacccagccccccagagactcagaaggcagaactggaagaaggggtctataggatcaagcagcaaggaatttttggaaaaacccaagtgggggttggaatacaaaaagaaggagttttccacaccatgtggcacgttacaagaggagcagtgttgacacacaatgggaaaagactggaaccaaactgggccagcgtgaaaaaagacctgatttcatacggaggaggatggagattgagtgcacaatggcaaaagggagaggaggtgcaggttattgccgtagagcctgggaagaacccaaagaactttcaaaccatgccaggcatttttcagacaacaacaggggaaataggagcgattgcactggacttcaagcctggaacctcaggatctcctatcataaacagagagggaaaggtagtgggactgtatggcaatggagtggtcacaaagaatggtggctatgtcagtggaatagcgcaaacaaacgcagaaccagacggaccgacaccagagttggaagaagagatgttcaaaaagcgaaatctaaccataatggatcttcatcctgggtcaggaaagacgcgaaaatatcttccagccattgttagagaggcaatcaagagacgcttaaggactttaattttggcaccaacaagggtggttgcagctgagatggaagaagcattgaaggggctcccaataaggtatcaaacaactgcaacaaaatctgaacacacaggaagggagattgttgatctaatgtgccacgcaacgttcacaatgcgcttgctatcaccagtcagggttccaaactacaatttgataataatggatgaggctcatttcacagacccagccagtatagcggctagggggtacatatcaactcgtgtaggaatgggagaggcagccgcaattttcatgacagccacaccccccggaacagctgatgcctttcctcagagcaacgctccaattcaagatgaagaaagagacataccagaacgctcatggaattcaggcaatgaatggattaccgactttgttgggaagacggtgtggtttgtccctagcatcaaagctggaaatgacatagcaaactgcttgcggaaaaacggaaaaaaggtcattcaacttagtaggaagacttttgacacagagtatcaaaagaccaaactgaatgattgggacttcgtggtgacaacagacatctcagaaatgggagccaatttcaaagcagacagagtgatcgacccaagaagatgtctcaagccagtgattttgacagatgggcccgagcgcgtgatcctggcgggaccaatgccagtcaccgtagcgagcgctgcgcaaaggagagggagagtcggcaggaacccacaaaaagagaatgaccaatacatattcacgggccagcccctcaataatgatgaagaccatgctcactggacagaagcaaaaatgctgctagacaacatcaacacaccagaagggattataccagctctctttgaaccagaaagggagaagtcagccgccatagacggcgaataccgcctgaagggtgagtccaggaagaccttcgtggaactcatgaggaggggtgacctcccagtttggctgtcccataaagtagcatcagaagggatcaaatatacagatagaaaatggtgctttgatggagaacgcaataatcaaattttggaggagaatatggatgtggaaatctggacaaaggaaggagaaaagaaaaaattgagacctaggtggcttgatgcccgcacttattcagatcccttagcacccaaggaattcaaggattttgcagctggcagaaagtcaatcgctcttgatcttgtgacagagataggaagagtgccttcacacttagcccacagaacgagaaacgccctggacaatttggtgatgctgcacacgtcagaacatggcgggagggcctataggcatgcagtggaggaactaccagaaacaatggaaacactcctactcttgggactcatgatcctgttaacaggtggagcaatgcttttcctgatatcaggtaaagggattggaaagacttcaataggactcatttgtgttattgtttccagtggcatgttatggatggctgatgtcccactccaatggatcgcgtcggccatagtcctggagtttttcatgatggtgttactcataccagaaccagaaaagcagagaactccccaagataaccaactcgcatatgtcgtgataggcatacttacattggctgcgatagtagcagccaatgaaatgggactattggaaaccacaaagagagatttaggaatgtccaaagaaccaggtgttgtttcctcaaccagttatttggatgtggacctgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacctaggcgtaccactactggcattgggctgctattcacaagtgaacccactaactctcacagcggtggtactcctgctagttacgcattatgccattataggtccaggattgcaggcaaaagccactcgtgaagctcaaaaaaggacagctgcaggaataatgaagaatccaacggtggacgggataatgacaatagacctagatcctgtaatatacgattcaaaatttgaaaagcaactaggacaggttatgctcctggtcctgtgtgcagttcaacttctgttaatgagaacatcatgggccttgtgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacggggtcacaaggtgaaaccttgggggaaaagtggaaaaagaaattaaatcaattatcccggaaagagtttgacctttacaagaaatccgggatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagtcacagaagtgcgaggatacacaaaaggtggcccaggacatgaagaaccagtacctatgtctacatacggatggaacatagtcaagttaatgagtggaaaggatgtgttttatctcccacctgaaaagtgtgacactctattgtgtgacattggagaatcttcaccaagcccaacagtggaagaaagcagaaccataagagtcttgaagatggttgaaccatggctaaaaaacaaccagttttgcattaaagtactgaacccttacatgccaactgtaattgagcacctagaaagactacaaaggaaacatggaggaatgcttgtgagaaatccactctcacgaaactccacgcacgaaatgtactggatatccaatggtacaggcaacatcgtctcttcagtcaacatggtatccagattgctactgaacagattcacaatgacacacaggagacccaccatagagaaagatgtggatttaggagcaggaactcgacatgtcaatgcggaaccagaaacacccaacatggatgtcattggggaaagaataaaaaggatcaagggggagcatagtaaaacatggcactatgatgatgaaaatccttacaaaacgtgggcttaccatggatcctatgaagtcaaggccacaggctcagcctcctccatgataaatggagtcgtgaaactcctcacaaaaccgtgggatgtggtgcccatggtgacacagatggcaatgacagatacaactccatttgggcagcaaagagttttcaaagagaaagtggacaccaggacacccaggcccatgccagggacaagaaaggttatggagatcacagcggagtggctttggagaaccctgggaaggaacaaaagacctagactgtgcacaagggaagaatttacaaaaaaggtcagaaccaacgcggctatgggagccgtcttcacagaggagaaccaatgggatagtgcgagagctgctgttgaggacgaggaattctggaaacttgtggacagagaacgtgaactccacaaattgggcaagtgtggaagctgcgtctacaacatgatgggtaagagagagaagaaacttggagagtttggtaaagcaaaaggcagtagggctatatggtacatgtggttgggagccaggtaccttgagttcgaagcactcggatttttaaatgaagaccactggttctcgcgtgaaaactcttacagtggagtagaaggagaaggactgcataagttgggatacatcttaagagatatttccaagatacccggaggagccatgtatgctgatgacacagctggttgggacacaagaataacagaagatgacctgcataatgaggaaaaaatcacacagcaaatggaccctgaacacaggcagttagcaaacgctatattcaagctcacataccaaaacaaagtggtcaaagttcaacgaccaactccaaagggcacagtaatggacattatatctaggaaagaccaaagaggcagtggacaggtgggaacttatggtctgaatactttcaccaacatggaagctcagttaattagacagatggaaggagaaggtgtgttgtcgaaggcagacctcgagaaccctcatctgctagagaagaaaatcacacaatggttggaaactaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaagggatggcatgattggcaacaggtccctttctgctcccaccactttcatgaattgatcatgaaagatggaagaaagttggtagttccctgcagaccccaggacgaactaataggaagagcgaggatctctcaaggagcaggatggagcctcaaagaaactgcatgtctagggaaagcctacgctcaaatgtggagtctcatgtattttcacagaagagatcttagactagcatccaacgccatttgctcagcagtaccagcccattgggtccccacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 1326 - DNA, 10173 bp, Dengue virus; identical to SEQ ID NO: 1325

SEQ ID NO: 1327 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggccttcatagctttcctcagatttctagccattccaccaacagcaggagtcttggctagatggggaacctttaagaagtcgggagctattaaggtcctgagaggcttcaagaaggagatctcaaacatgctgagcattatcaacagacgaaaaaagacatcgttttgtctcatgatgatgttaccagcaacacttgctttccacttgacttcacgagatggagagccgcgcatgattgtggggaagaatgaaagaggaaaatctctactttttaagacagcctctggaatcaacatgtgcacactcatagccatggatttgggagagatgtgtgatgacacggtcacttataaatgccccctcattactgaagtggagcctgaagacatcgactgctggtgcaacctcacatcgacatgggtgacctacggaacgtgcaatcaagctggagagcatagacgcgacaagagatcagtggcgttagctccccatgtcggcatgggactggacacacgcacccaaacctggatgtcggctgagggagcttggagacaagtcgagagggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgagcacggtgggtgtgtgactaccatggctaagaacaagcccacgctggatatagagctccagaagaccgaggccacccaactggctaccctaaggaaactatgcattgagggaaaaattaccaacgtaacaaccgactcaaggtgtcccacccaaggggaagcgatcttacctgaggagcaggaccagaactacgtgtgtaagcacacatacgtggacagaggctggggaaacggttgtggtctgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgttgaagccatcctacctgaatatgggacccttgggctagaatgctcaccacgaacaggtttagatttcaatgaaatgattttgttgacaatgaagaacaaagcatggatagtgcatagacaatggttttttgacctacctctaccatggacatcaggagctacaacagaaacaccaacctggaataagaaagagcttcttgtgacattcaaaaacgcacatgcaaaaaagcaagaagtagtagttcttggatcgcaagagggagcgatgcacacagcactgacaggagccacagagatccagacctcaggaggcacaagtatttttgcggggcacttaaaatgtagactcaagatggacaaattggaactcaaggggatgagctatgcaatgtgcttgaatgcctttgtgttgaagaaagaagtctccgaaacgcaacatgggacaatactcattaaggttgagtacaaaggggaagatgcaccttgtaagattcccttctccacggaggatggacaagggaaagcccacaatggcagactgatcacagcaaacccagtggtgaccaagaaggaggagcctgtcaatatcgaggcagaacctccttttggggaaagtaatatagtgattggaattggagacaaagccttgaaaattaactggtataagaagggaagctcgattgggaagatgttcgaggccactgccagaggtgcaaggcgcatggctatcctgggagacacagcctgggactttggatcagtaggtggtgttttaaattcattagggaaaatggtgcaccaaatatttggaagtgcttacacagccttatttagtggagtctcctggataatgaaaattggaataggtgtcctcttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcaccaatgaggtccacacctggacagagcaatacaaatttcaagcagactcccccaaaagactggcgacagccattgcaggcgcttgggagaatggagtgtgcggaatcaggtcgacaaccagaatggagaacctcttgtggaagcaaatagccaatgaactgaactacatattatgggaaaacaacatcaaattaacagtagttgtgggtgacataattggggtcttagagcaagggaaaagaacactaacaccacaacccatggagctaaaatattcatggaaaacatggggaaaggcgaaaatagtgacagctgaaacacaaaattcctctttcataatagatgggccaagcacaccagagtgtccaagtgcctcaagagcatggaatgtgtgggaggtggaagattacgggtttggagtcttcacaactaacatatggctgaaactccgagagatgtacacccaactatgtgaccacaggctaatgtcggcagccgttaaggatgagagagccgtacacgccgacatgggctattggatagaaagccaaaagaatggaagttggaagctagaaaaggcatccctcatagaggtgaaaacttgcacatggccaaaatcacacactctttggagcaatggtgtgctagagagtgacatgatcatcccaaagagtctggctggtcctatttcgcaacacaaccacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagctgatacacgaatggtgttgccgctcgtgcacacttcctcccctgcgatacatgggagaagacggctgttggtatggcatggaaattagacccattaatgagaaagaagagaacatggtaaagtccttagtctcagcagggagtggaaaggtggataatttcacaatgggtgttttgtgtttggcaatcctctttgaagaggtgatgagaggaaagtttgggaaaaaacacatgattgcaggggttctcttcacgtttgtgctccttctctcagggcaaataacatggagagacatggcgcacacactcataatgattgggtccaacgcctctgacagaatgggaatgggcgtcacttatctggctttgattgcgacatttaaaattcagccatttttggctttgggattcttcctgaggaaattgacatctagagaaaatttattgttgggagttggattggccatggcaacaacgttacaattgccagaggacattgaacaaatggcgaatggaattgctttggggctcatggttcttaaattaataacacaatttgaaacataccaactatggacggcattagtctccctaacgtgttcaaacacaattttcacgttgactgtcgcctggagaacagccaccctaattttggccggaatttcgcttctaccagtgtgccagtcttcgagcatgaggaaaacagattggctcccaatgactgtggcagctatgggagttccacccctaccactctttatcttcagtttgaaagacacgctcaaaaggagaagctggccactgaatgagggagtgatggctgttggacttgtgagcattctagctagttctctccttaggaatgacgtgcccatggctggaccattaatagctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgaggataaaagatgatgagactgagaacatcttgacagtgcttttgaaaacagcactactaatagtgtcaggcatctttccatactccattcccgcgacactgctggtctggcacacttggcagaagcaaacccagagatccggcgtcctatgggacgtacccagtcccccagagacacagaaagcagaactggaagaaggggtctataggattaagcagcaaggaattcttggaaaaacccaagtgggggttggagtacaaaaagaaggagttttccacactatgtggcacgtcacaagaggagcagtgttgacacataatgggaaaagactggaaccaaactgggctagcgtgaaaaaagatctgatttcatacggagggggatggagattgagtgcacaatggcaaaaaggagaggaggtgcaggttattgccgtagagcctgggaagaacccaaagaactttcaaaccatgccaggcattttccagacaacaacaggggagataggagcaattgcactggacttcaagcctggaacttcaggatctcctatcataaacagagagggaaaggtagtgggactgtatggcaatggagtggtcacaaagaatggtggctatgtcagtggaatagcacaaacaaatgcagaaccagacggaccagcaccagagttggaagaagagatgttcaaaaaacgaaatctaactataatggaccttcatcccgggtcaggaaagacgcggaaataccttccagctattgtcagagaggcaatcaagagacgcttaaggactctaattttggcaccaacaagggtggttgcagctgagatggaagaagcattgaaagggctcccaataaggtatcaaacaactgcaacaaaatctgaacacacaggaagagagatcgttgatctaatgtgccacgcaacgttcacaatgcgtttgctgtcaccagtcagggttccaaactacaacttaataataatggatgaggctcatttcacagacccagccagcatagcggctagagggtacatatcaactcgtgtaggaatgggagaagcagccgcaattttcatgacagccacaccccctggaacagctgacgcctttcctcagagcaactctccaatccaagatgaagaaagagacataccagaacgctcatggaattcaggcaatgaatggattaccgactttgtcgggaagacggtgtggtttgtccctagcatcaaagctggaaatgacatagcaaactgcttgcggaagaatggaaagaaggtcattcaacttagtaggaagacttttgacacagaatatcaaaagaccaaactaaatgattgggactttgtggtgacaacagacatttcagaaatgggagccaacttcaaagcagacagagtgatcgacccaagaaggtgtctcaagccagtgattttgacagacggacccgagcgcgtgatcctggcgggaccaatgccagtcaccgtagcgagcgctgcgcaaagaagagggagagttggcaggaacccacaaaaagaaaatgaccaatacatattcacgggtcagcccctcaataatgatgaagaccatgctcactggacagaagcaaaaatgctgctggacaacatcaacacaccagaagggatcataccagctctctttgaaccagaaagggagaagtcagccgccatagacggcgagtatcgcttgaagggtgagtccaggaagaccttcgtggaactcatgaggaggggtgacctcccagtttggctagcccataaagtagcatcagaagggatcaaatatacagatagaaaatggtgttttgatggagaacgcaacaatcaaattttagaggagaacatggatgtagaaatctggacaaaggaaggagaaaagaaaaaattgaggcctagatggcttgatgcccgcacttattcagatcccctagcactcaaggaattcaaggactttgcggctggtagaaagtcaattgcccttgatcttgtgacagaaataggaagagtgccttcacacctagcccacagaacgaaaaacgccctggacaacttggtgatgttgcacacgtcggaacatggcgggagggcctacaggcatgcagtggaggaactaccagaaacaatggaaacactcttactcctgggactcatgatcttgttaacaggtggagcaatgctcttcttgatatcaggtaaagggattggaaagacttcaataggacttatttgtgtagttgcctccagcggtatgctatggatggctgatgtcccactccaatggatcgcgtcggctatagtcctggagttttttatgatggtgctacttataccagaaccagaaaagcagagaactccccaagacaatcaacttgcatatgtcgtgataggcatacttacattggctgcaatagtagcagccaatgaaatgggactgttggaaaccacaaagagagatttaggaatgtccaaagaaccaggcgttgtttctccaactagctatttggatgtggacttgcacccagcatcagcctggacattgtacgctgtggccacgacagtaataacaccaatgttgagacataccatagagaattccacagcaaatgtgtccttggcagctatagctaaccaggcagtggtcctgatgggtttagacaaaggatggccgatatcgaaaatggacttaggtgtaccattgttagcactaggttgctattcacaagtgaacccactaactctcacagcggcagtactcctgctagtcacgcattatgctatcataggtccaggattgcaggcaaaagccactcgtgaagcccaaaaaaggacagctgctggaataatgaagaatccaacggtggatgggataatgacaatagacctagatcctgtaatatatgattcaaagtttgaaaaacaactaggacaggtcatgctcctagttctgtgtgcagttcaacttttgttaatgagaacatcatgggctttttgtgaagctctaaccctagccacaggaccaataacaacactctgggaaggatcacctgggaagttctggaacaccacaatagccgtttccatggcgaacatctttagagggagctatttagcaggagctgggcttgcattttctatcatgaaatcagttggaacaggaaagagaggaacagggtcacaaggtgaaaccttgggagaaaagtggaaaaagaaattgaatcaattatcccggaaagagtttgacctttacaagaaatctggaatcaccgaagtggatagaacagaagccaaagaagggttgaaaagaggagaagtaacacaccatgccgtgtccagaggtagcgcaaaacttcaatggctcgtggagagaaacatggtcatccccgaaggaagagtcatagacttaggctgtggaagaggaggctggtcatattattgtgcaggactgaaaaaagttacagaagtgcgaggatacacaaaaggtggcccaggacatgaagaaccagtgcctatgtctacatatggatggaacatagtcaagttaatgagtggaaaggatgtgttttatcttccacctgaaaaatgtgatactctattgtgtgacattggagaatcttcaccaagcccaacagtggaagaaagcaggaccataagagtcttgaagatggttgaaccatggctaaaaaataaccagttttgtattaaagtattgaacccctacatgccaactgtgattgagtacttagaaagactacaaaggaaacatggaggaatgcttgtgagaaatccactctcacgaaactccacgcacgaaatgtactggatatctaatggcacaggcaatatcgtctcttcaatcaacatggtatccagattgctactgaacagattcacaatgacacacaggagacccaccatagagaaggatgtggatttaggagcggggacccgacatgtcaatgcggaaccagaaacacctaacatggatgtcattggggaaagactaagaaggatcaaggaggagcatagctcaacatggcactatgatgatgaaaatccttataaaacatgggcttaccatggatcctatgaagttaaggccacgggctcagcctcctccatgataaatggagtcgtgaaactcctcacgaaaccatgggatgtggtgcccatggtgacacagatggcaatgacggatacaactccttttggccagcaaagggttttcaaagaaaaagtagacaccaggacacctagacccatgccaggaacaagaagggttatggagatcacagcggaatggctttggagaactctgggaaggaataaaagacccagattgtgcacaagagaggagttcacaaagaaggtcagaaccaacgcagccatgggcgccgttttcacagaggagaaccaatgggacagtgctagagctgctgttgaagatgaagaattctggaaactcgtggacagagaacgtgaactccacaaattgggcaagtgcggaagctgtgtttacaacatgatgggcaagagagagaagaaacttggggagtttggcaaagcaaaaggcagtagagctatatggtacatgtggttgggagccaggtaccttgagttcgaggcactaggattcttaaatgaagaccattggttctcgcgtgaaaactcttacagtggagtagaaggagaaggactgcacaagctgggatacatcttaagagacatttccaagatacccggaggagctatgtatgctgatgacacagctggttgggatacaagaataacagaagatgacctgcacaatgaggaaaaaatcacacagcaaatggaccctgaacacaggcagttggcaaacgctatattcaagctcacataccaaaataaagtggtcaaagttcaacgaccaactccaaagggcacggtaatggacatcatatctaggaaagatcaaagaggcagtggacaggtgggaacttatggtctgaatacattcactaacatggaagcccagttaatcagacaaatggaaggagaaggtgtgttgtcaaaggcagacctcgagaaccctcatctgctagagaagaaaatcacacaatggctggaaaccaaaggagtggagaggttaaaaagaatggctatcagcggggatgattgcgtggtgaaaccaatcgatgacaggttcgccaatgccctgcttgccctgaatgacatgggaaaagttaggaaggacataccccaatggcagccatcaaagggatggcatgattggcaacaagtcccattctgttcccaccactttcatgaattgatcatgaaagatggaagaaggttggtagttccatgcagacctcaggatgaattaataggaagagcgagaatctctcaaggagcaggatggagccttagagaaaccgcatgcctagggaaagcctacgcccaaatgtggactctcatgtattttcacagaagagatcttagactagcatccaacgccatatgttcagcagtaccagtccattgggtccccacaagcagaacgacgtggtctattcatgctcaccatcagtggatgactacagaagacatgcttactgtttggaacagggtgtggatagaggataatccatggatggaagacaaaactccagtcacaacttgggaagatgttccatatctagggaagagagaagaccaatggtgcggatcgctcattggtctcacttccagagcaacctgggcccagaacatacttacggcaatccaacaggtgagaagcctcataggcaatgaagagtttctggactacatgccttcgatgaagagattcaggaaggaggaggagtcagagggagccatttggtaa

SEQ ID NO: 1328 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccgacagcaggagtcttggctagatggggtaccttcaagaagtcgggggctattagggtcctgagaggcttcaagaaggagatctcaaacatgctgagcatcatcaacagacggaaaaagacatcgatctgtctcatgatgatgttaccagcaacacttgccttccacttgacttcacgagatggagagccgcgcatgattgtggggaagaatgaaagaggaaaatccctacttttcaagacagcctctggaattaacatgtgcacacttatagccatggatttgggagagatgtgtgatgacacggtcacttacaaatgccccctcattactgaagtggagcctgaagacattgactgctggtgcaaccttacatcgacatgggtgacctacggaacgtgtaatcaagctggagagcatagacgcgataagagatcggtggcgctagctccccatgtcggcatgggactggacacacgcacccaaacctggatgtcggctgaaggagcttggagacaagtcgagaaggtagagacatgggcctttaggcacccagggttcacaatattagccctatttcttgcccattacataggcacttccttgacccagaaagtggtcatcttcatattactaatgctggtcaccccatccatgacaatgaggtgtgtgggagtaggaaacagagattttgtggaaggcctatcaggagctacgtgggttgacgtggtgctcgagcacggagggtgtgtgaccaccatggctaagaacaagcccacgctggatatagagctccagaagaccgaggccacccaactggcgaccctaagaaaactatgcattgagggaaaaattaccaacgtaacaaccgactcaaggtgccccacccaaggggaagcgattttacctgaggagcaggaccaaaactacgtgtgtaagcacacatacgtggacagaggctggggaaacggttgtggtttgtttggcaagggaagcttggtaacatgcgcgaaatttcaatgtttggaatcaatagagggaaaagtggtgcagcatgagaacctcaaatacaccgttatcatcacagtgcacacaggagaccaacaccaggtgggaaatgaaacgcagggggtcacggctgagataacaccacaggcatcaaccgttgaagccatcttacctgaatatggaacccttgggttagaatgctcaccacggacaggtttagatttcaatgaaatgatcttgttgacaatgaagaacaaagcatggatggtacatagacaatggttttttgacctacctttaccatggacatcaggggctacaacagaaacaccaacctggaacaagaaagagcttcttgtgacattcaagaacgcacatgcaaaaaaacaagaagtagtggtccttggatcgcaagagggagcaatgcacacagcactgacaggagccacagagatccaaacctcaggaggcacaagcatctttgcggggcacttaaaatgcagactcaagatggacaaattggaactcaaggggatgagctatgcaatgtgcttgaatgcctttgtgttgaagaaagaagtctccgaaacgcaacatgggacaatactcattaaggttgagtacaaaggggaagatgcaccctgcaggattcctttctccacggaggatggacaagggaaagctcacaatggcagactaatcacagctaacccagtggtgaccaagaaggaggagcccgtcaatattgaggcagaacctccttttggggaaagcaacatagtgattggaattggagacaaagctttgaaaatcaactggtacaagaagggaagctcgattgggaagatgttcgaggccactgccagaggtgcaaggcgcatggccatcctgggagatacagcctgggactttggatcagtaggtggtgttttaaattcattaggaaaaatggtgcatcaaatatttggaagtgcttatacggccctatttagtggagtctcctggataatgaaaattggaataggtgtccttttaacctggatagggttgaactcaaaaaacacttctatgtcattttcatgcattgtgataggaatcatcacactctatctgggagccgtggtgcaagctgacatggggtgtgtcataaactggaaaggcaaagaactcaaatgtggaaatggaattttcgtcactaatgaggtccatacctggacagagcaatacaaatttcaagcagactcccccaaaagactggcgacagccattgcaggcgcttgggagaatggagtgtgcggaattaggtcaacaaccagaatggagaacctcttgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaagctagaaaaagcatccctcatagaggtgaaaacctgcacatggccaaaatcacacactctttggagcaatggtgtgctagagagtgacatgattatcccaaagagtctagctggtcccatttcgcaacacaaccacaggcccgggtaccacacccaaacggcaggaccctggcacttaggaaagttggagctggacttcaactattgtgaaggaacaacagttgtcatcacagaaaattgtgggacaagaggcccgtcactgaggacaacaacagtgtcagggaagttgatacacgaatggtgttgccgctcgtgtacacttcctcccctgcgatacatgggagaggacggctgctggtatggcatggaaattagacccattaatgagaaagaagagaacatggtaaagtctttagtctcagcagggagtggaaaggtggataacttcacaatgggtgtcctgtgtttggcaatcctctttgaggaagtgatgagaggaaaatttgggaaaaaacacatgattgcaggggttctcttcacgtttgtgctccttctctcagggcaaataacatggagagacatggcgcacacactcataatgattgggtccaacgcctctgacagaatgggaatgggtgtcacttacctagcattgattgcaacatttaaaatccagccatttttggctttgggattctttctgaggaaactgacatctagagaaaatttattgttgggagttgggttggccatggcaacaacgttacaactgccagaggacattgaacaaatggcgaatggagtagctttggggcttatggctcttaaattaataacacaatttgaaacataccaactgtggacggcactagtctccctaatgtgttcaaacacaattttcacgttgactgttgcctggagaacagccaccctgattttggctggaatttcgcttttgccagtgtgccagtcttcgagcatgaggaaaacagattggctcccaatgactgtggcagctatgggagttccacctctaccactttttatcttcagtttgaaggacacgctcaaaaggagaagctggccactgaatgagggggtgatggccattggacttgtgagcattctggctagttctctccttaggaatgacgtgcccatggctggaccattagtggctgggggcttgctgatagcgtgctatgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcctaacagtgcttttgaaaacagcattactaatagtgtcaggcatttttccgtactccatacccgcaacactgctggtctggcacacctggcaaaagcaaacccaaagatccggcgtcctatgggacgtacccagccccccagagactcagaaggcagaactggaagaaggggtttataggattaagcagcaaggaatttttgggaaaacccaagtgggggttggaatacaaaaagaaggagttttccacaccatgtggcacgttacaagaggagcagtgttgacacacaatgggaaaagactggaaccaaactgggctagcgtgaaaaaagacctgatttcatacggaggaggatggagattaagtgcacaatggcaaaaaggagaggaggtgcaggttatcgccgtagagcctgggaagaacccaaagaactttcaaactatgccaggcattttccagacaacaacaggggagataggagcgattgcactggacttcaagcctggaacttcaggatcccccatcataaacagagagggaaaggtagtgggactgtatggcaatggagtggtcacaaagaatggtggctatgtcagtggaatagcacaaacaaatgcagaaccagacggaccgacaccagagttggaagaagaaatgttcaaaaagcgaaatctaactataatggatctccatcccgggtcaggaaagacacggaaataccttccaactattgtcagagaggcaatcaagagacgcttaaggactctaattttggcgccaacaagggtggttgcagctgagatggaagaagcattgaaagggctcccaataaggtatcaaacaactgcaacgaaatctgaacatacagggaaagagattgttgatctaatgtgccacgcaacgttcacaatgcgtttgctgtcgccagtcagagttccaaactacaacttgataataatggatgaggctcatttcacagacccagccagtatagcggctagagggtacatatcaactcgtgtaggaatgggagaggcagccgcaattttcatgacagccacaccccctggaacagctgatgcctttcctcagagcaacgctccaattcaagatgaagaaagggacataccagaacgctcatggaattcaggcaatgaatggattaccgactttgtcgggaagacggtgtggtttgtccctagcatcaaagctggaaatgacatagcaaactgcttacggaaaaacggaaaaaaggtcattcaacttagtaggaagacttttgacacagaatatcaaaagactaaactaaatgattgggactttgtggtgacaacagacatttcagaaatgggagccaatttcaaagcagacagagtgatcgacccaagaagatgcctcaagccagtgatcttgacagacggacccgagcgcgtgatcctagcgggaccaatgccagttaccgtagcgagcgctgcgcagaggagagggagggttggcaggaacccacaaaaggaaaatgaccaatacatattcacgggccagccccttaataatgatgaagaccacgctcactggacagaagcaaaaatgctgctagataacatcaacacaccagaagggatcataccagctctctttgaaccagaaagggagaagtcagccgccatagatggcgaataccgcctgaaaggtgagtccaggaagaccttcgtggaactcatgaggaggggtgacctcccagtctggctagcccataaagtagcatcagaagggatcaaatacacagatagaaaatggtgttttgatggagaacgcaacaatcaaattttagaggagaatatggatgtggaaatctggacaaaggaaggagaaaagaagaaattgaggcctaggtggcttgatgcccgcacttattcagatcccttggcgctcaaggaattcaaggactttgcggctggtagaaagtcaattgcccttgatcttgtgacagaaataggaagagtgccttcacacttagcctacagaacgagaagcgccctggacaatctggtgatgttgcacacgtcagaacatggcgggagggcctacaggcatgcagtggaggaactaccagaaacaatggaaacactcttactcctgggactcatgatcctgttaacaggcggggcaatgcttttcttgatatcaggtaaagggattggaaagacttcaataggactcatttgtgtagttgcttccagcggtatgttatggatggctgatgtcccactccaatggatcgcgtcggccatagtcctggagttttttatgatggtgctactcataccagaaccagaaaagcagagaactcctcaagacaatcaactcgcatatgtcgtgataggcatacttacattggctgcaatagtagcagccaatgaaatgggactgttggaaaccacaaagagagatttaggaatgtccaaagaaccaggtgtcgtttctccaaccagttacttggatgtggacttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtaccactactggcactgggttgttattcacaagtgaacccactaactctcacagcggcagtacttctgctagtcacgcattatgccattataggtccaggattgcaggcaaaagccacccgtgaagctcaaaaaaggacagcagctggaataatgaagaatccaacggtggatgggataatgacaatagacctagatcctgtgatatacgattcaaaatttgaaaagcaactaggacaggttatgctcctggttctgtgtgcagttcaacttttgctaatgagaacatcatgggctttttgtgaagctctaaccctagccacaggaccgataacaacactctgggaaggatcacctgggaagttttggaataccacgatagctgtctccatggcgaacatctttagagggagctacttagcaggagctgggcttgctttttctatcatgaaatcagttggaacaggaaagagaggaacagggtcacaaggtgaaaccttgggagaaaagtggaaaaagaaattgaatcagttatcccggaaagagtttgatctttacaagaaatccggaatcactgaagtggatagaacaaaagccaaagaagggttgaaaagaggggaaacaacacaccacgccgtatccagaggcagcgcaaaacttcaatggttcgtggagagaaacatggtcatccccgaaggaagagtcatagacttgggctgtggaagaggaggctggtcatattattgtgcgggactgaaaaaagttacagaagtgcgaggatacacaaaaggcggcccaggacatgaagaaccagtacccatgtctacatacggatggaacatagtcaagttaatgagtggaaaggatgtgttttatcttccacctgaaaagtgtgataccctattgtgtgacattggagaatcttcaccaagcccaacagtggaagaaagcagaaccataagagtcctgaagatggttgaaccatggctaaaaaataaccagttttgcattaaagtattgaacccttacatgccaactgtgattgagcacctagaaagactacaaagaaaacatggaggaatgcttgtgagaaatccactctcacgaaactccacgcacgaaatgtactggatatctaatggcacaggcaatatcgtctcttcagtcaacatggtatccagattgctactgaacagattcacaatgacacataggagacccaccatagagaaagatgtggatttaggagcggggacccgacacgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaagccacaggctcagcctcctccatgataaatggagtcgtgaagctcctcacgaaaccatgggatgtggtgcccacggtgacacagatggcaatgacggatacaaccccattcggccagcaaagggtttttaaagagaaagtggacaccaggacacccagacctatgccaggaacaagaaaggttatggagatcacagcggaatggctttggagaaccctaggaaggaataaaagacccagactatgcacgagagaggagttcacaaaaaaggtcagaaccaacgcagctatgggcgccgttttcacagaggagaaccaatgggacagtgctagagctgccgttgaagatgaagaattctggaaactcgtggacagagaacgtgaactccacaagctgggcaagtgtggaagctgcgtttacaacatgatgggcaagagagagaagaaacttggagagtttggcaaagcaaaaggcagtagagctatatggtacatgtggttgggagccaggtaccttgagttcgaggcactcggattcttaaatgaagaccattggttctcgcgtgaaaattcttacagtggagtagaaggagaaggactgcataagctgggatacatcttaagagatatttccaagacacccggaggagctatgtatgctgatgacacagctggttgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggtagtggacaggtgggaacttatggcttgaatacatttaccaacatggaagcccagttaatcagacaaatggaaggagaaggtgtgttgtcgaaggcagacctcgagaaccctcatctgccagagaagaaaatcacacaatggttagaaaccaaaggagtagagaggttaaaaagaatggccatcagcggggatgattgtgtggtgaaaccaattgatgacaggttcgccaatgccctgcttgccctgaatgacatgggaaaagttaggaaggacatacctcaatggcagccatcgaagggatggcatgattggcaacaggtccctttctgctcccaccactttcatgaattgatcatgaaagatggaagaaagctggtagttccctgcagaccccaggatgaattaatagggagagcgagaatctctcaaggagcaggatggagccttaaagaaactgcatgcctagggaaagcctacgcccaaatgtggagtctcatgtattttcacagaagagatcttagactagcatctaacgccatatgttcagcagtaccagtccattgggtccccacaagcagaacgacgtggtctattcatgctcaccatcagtggatgactacagaagacatgcttactgtttggaacagggtgtggatagaggataatccatggatggaggataaaactccagtcacaacttgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcgatgaagagattcaggaaggaggaggagtcagagggagccatttggtaa

SEQ ID NO: 1329 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgagattggttatggcattcatagctttcctcagatttctagccatcccaccaacagcaggagttttggctagatggggaaccttcaagaagtcaggggctattaaggtcctaaaaggcttcaagaaggagatttcaaacatgctgagcattatcaacaaaaggaaaaagacatcgctctgtctcatgatgatgttaccagcaacacttgctttccacttgacttcacgcgatggagagccgcgcatgattgtaggaaagaatgaaagagggaaatccctactttttaagacagcttctggaattaacatgtgcacactcatagccatggacctaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgcacccaaacctggatgtcggctgaaggagcttggagacaagtcgagaaggtagagacatgggctcttaggcacccagggttcaccatactagctctatttcttgcccattacataggcacttccctgacccagaaagtggttatttttatactactaatgctggtcactccatccatgacaatgagatgcgtgggagtaggaaacagagattttgtggaaggtctgtcgggagctacgtgggttgatgtggtgctcgagcacggtgggtgtgtaaccaccatggctaagaacaagcctacgctggacatagagcttcaaaagaccgaggccacccaactggcgaccctaaggaagttatgcattgagggaaaaattaccaacataacaactgactcaaggtgtcctacccaaggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcagcatgagaacctcaaatacactgtcatcattacagtgcacacaggagaccaacaccaggtgggaaatgacacgcagggagtcacggttgagataacaccccaggcatcaaccgttgaagctatcttgcctgaatatggagcccttgggctagaatgctcaccacggacaggtctggatttcaatgaaatgattttattgacaatgaagaataaagcatggatggtacacaggcaatggttctttgacctacccctaccatggacatcaggagctacaacagagacaccaacttggaacaggaaagagcttcttgtgacattcaaaaatgcacatgcaaaaaagcaagaagtagttgtccttggatcgcaagagggagcaatgcacacagcgctgacaggagctacagagattcaaaactcaggaggcacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagctcacaatggcagactgatcacagccaacccagtggtgaccaagaaggaggagcctgtcaacattgaggctgaacctccttttggggaaagtaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcatcaaatattcggaagtgcttacacagccctgtttagtggagtctcatggataatgaaaattggaataggtgtcctcttaacctggatagggctgaattcaaaaaacacttccatgtcattttcatgcattgcgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacaacccatggagctaaaatattcatggaaaacatggggaaaggcaaaagtagtgacagctgaaacacaaaattcctctttcataatagatgggccaaacacaccggaatgtccaagtgcctcaagagcatggaatgtgtgggaggtggaagattacgggtttggagtcttcacaaccaatatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagttgatacatgaatggtgttgccgctcgtgcacacttcctcccttgcgatacatgggagaggacggttgctggtatggcatggaaattagacctgtcaatgagaaagaagagaacatggtaaagtctttagtctcagcagggagtggaaaggtggacaacttcacaatgggagtcctgtgtttggcaatcctcttcgaagaggtgatgagaggaaaatttgggaagaaacacatgattgcaggggttctcttcacgtttgtgctccttctctcagggcaaataacatggagggatatggcacacacactcataatgattgggtccaacgcttctgacaggatgggaatgggcgttacctacctagctttaattgcaacattcaaaattcagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacataccagttgtggacggcattagtctccctaacgtgttcaaacacaattttcacgttgactgttgcctggagaacagccaccttgattctggccggagtctcgcttttgccactgtgccagtcttcgagcatgaggaaaacagattggctcccaatgactgtggcagctatgggagttccacccttaccactttttatcttcagtttgaaggacacactcaaaaggaggagctggccactgaatgagggagtgatggctgttgggcttgtgagcattctagctagttctctccttaggaatgatgtgcccatggctggaccactagtggccgggggcttgctgatagcgtgctatgtcataactggcacgtcagcagatctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattgctaatagtatcaggcatctttccatactccatacccgccacactgttggtctggcatacttggcaaaagcaaacccaaagatctggtgttctatgggacgtacccagtcccccagaaacacagagagcagaactggaagagggggtctataggatcaaacaacaaggaatttttgggaaaacccaagtgggggttggagtacataaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccacgccgggcatttttcagacaacaacgggggaaataggagcaattgcactagacttcaagcctggaacttcaggatctcctatcataaacagagagggaaaggtagtgggactgtatggcaatggagtggtcacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcattgaaaggactcccaataaggtatcaaacaacagcaacaaaatctgaacacacaggaagggagattgttgacttaatgtgccacgcaacgttcacaatgcgcttgctatcaccagtcagggttccaaactacaatttgataataatggatgaggcccatttcacagatccagccagtatagcggctagagggtacatatcaactcgtgtaggaatgggagaggcagctgcaattttcatgacagcaacaccccctggaacagccgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcgaaaaaatggaaaaaaggtcatccaacttagtaggaagacttttgatacagaatatcaaaagaccaaactgaatgattgggacttcgtggtgacaacagacatttcagaaatgggagctaactttaaagcagatagagtgatcgacccaagaagatgtctcaagccagtgattttgacagatggacccgagcgggtgattctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggattataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaagggatcaaatacacagatagaaaatggtgcttcgatggagaacgtaataatcaaattttagaggagaacatggatgtggaaatctggacaaaggaaggagaaaggaaaaaattgagacctaggtggcttgatgcccgcacttattcagatcccttggcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggacttatttgtgttattgcctccagtggcatgttatggatggccgatgtcccacttcaatggatcgcgtcggctatagtcctggaatttttcatgatggtgttgctcataccagaaccagaaaaacagagaactccccaagacaaccaactcgcatatgtcgtgataggcatactcacactggctgcgatagtagcagctaatgaaatgggactattggaaactacaaagagagatttaggaatgtctaaagaaccaggtgttgtttctccaaccagctatttagatgtagacttgcacccagcatcagcctggacattgtacgccgtggccacaacagtaataacaccaatgctgagacataccatagagaattccacagcaaatgtgtccctggcagccatagctaaccaggcagtggtcctgatgggtttagacaaaggatggccaatatcgaaaatggacctaggcgtaccactactggcactgggctgctattcacaagtgaacccactgactctcacagcggcagtacttctgctagttacacattatgccatcataggtccaggattgcaggccaaagccactcgtgaagctcaaaaaaggacagctgctggaataatgaagaatccaacggtggatgggataatgacaatagacctagatcctgtaatatacgattcaaaattcgaaaagcaactaggacaggttatgctcctggttctgtgtgcaattcaacttttgttaatgagaacatcatgggccttgtgtgaagctctaaccctagccacaggaccaataacaacactctgggaaggatcacctggaaagttttggaacaccacgatagctgtctccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtccacatacggatggaacatagttaagttaatgagtggaaaggatgtgttttatcttccacctgaaaagtgtgacacattattgtgtgacatcggagaatcttcaccaagcccaacagtggaagaaagcagaactataagagttttgaggatggttgaaccatggctaaaaaacaaccagttctgcattaaagtattaaacccttacatgccaactgtgattgagcacctggaaagactacaaagaaaatatggaggaatgcttgtgagaaacccactctcacgaaactctacgcatgaaatgtactggatatccaatggcaccggcaacatcgtttcttcagtcaacatggtatccagattgctactgaacagattcacaatgacacacaggagacccaccatagagaaagatgtggacttgggagcaggaacccgacatgtcaatgcggaaccagaaacacccaacatggacgtcattggagaaagaataaaaaggatcaaagaggagcatagttcaacatggcactatgatgaagaaaatccttataagacgtgggcttaccatggatcctatgaagtcaaagccacaggctcagcctcctctatgataaatggagtcgtgaaactcctcacaaaaccatgggatgtggtgcccatggtgacacagatggcaatgacagatacaaccccatttgggcagcaaagagtttttaaagagaaagtggacaccaggacacctaggcccatgccaggaacaagaaaggttatggagatcacagcggaatggctttggagaaccctgggaaggaacaaaagacccagattgtgcacaagggaagagttcacaaaaaaggtcagaaccaccgcggctatgggagccgttttcacggaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggctgggagccaggtaccttgagttcgaagcactcggatttttaaatgaagatcactggttctcgcgtgaaaactcttacagtggagtagaaggagaaggactgcacaagctgggatacattttaagagatatttccaagatacctggaggagctatgtatgctgatgacacagctggttgggacacaagaataacagaagatgacctgcataatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggggtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaagggttggcatgattggcaacaggtccccttctgctcccaccactttcatgaactgatcatgaaggatggaagaaagttggtggttccctgcagaccccaggatgaactaataggaagagcgagaatttctcaaggagcaggatggagccttaaagaaactgcatgtctggggaaagcctacgcacaaatgtggagtctcatgtattttcacagaagagatcttaggctagcatccaacgccatttgttcagcagtaccagtccattgggtccctacaagcagaacgacatggtctatccacgctcaccatcagtggatgactacagaagacatgcttactgtctggaacagggtgtggatagaggacaatccatggatggaagacaaaactccagtcacaacctgggaagatgttccatacctagggaagagagaagatcaatggtgtggatcactcatcggtcttacctccagagcaacctgggcccagaacatactcacggcaatccaacaggtgagaagccttataggcgatgaagagtttctggactacatgccttcgatgaagagattcaggaaggaggaggagtcagagggagccatttggtaa

SEQ ID NO: 1330 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttactaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttagagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtagttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1331 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1332 - DNA, 10173 bp, Dengue virus; identical to SEQ ID NO: 1330

SEQ ID NO: 1333 - DNA, 10173 bp, Dengue virus; identical to SEQ ID NO: 1331

SEQ ID NO: 1334 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcccaagaaggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1335 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagaaacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgaccacagaagacatgcttaccgtctggaacagggtgtggatagaggacaatccatggatggaagacaaaactccagtcacaacttgggaagatgttccatacctagggaagagagaagatcaatggtgtggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1336 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcattaatcaaattttagaggagaacatggatgtggaaatctggacaaaggaaggagaaaggaaaaatttgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1337 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagtgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccattctgggagacaccgcttgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcctatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggccatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1338 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttytttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1339 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccccgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1340 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcttcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1341 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaagagatttcaaacatgctgagcattatcaacaaaaggaaaaagacatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttytttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaagtgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1342 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatattattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgagggaaaaattaccaacataacaactgactcaagatgtcctacccaaggggaagcggttttgcctgaggagcaggaccagaactacgtgtgtaagcatacatacgtagacagaggctgggggaacggttgtggtttgtttggcaaaggaagcttggtgacatgcgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaacccatgaagcactcttgcctgaatatggaacccttgggctagaatgctcaccacggacaggtttggatttcaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgttcgaggccactgccaggggtgcaaggcgcatggccatcttgggagacacagcttgggactttggatcagtgggtggtgttctgaactcattaggcaaaatggtgcaccaaatatttggaagtgcttatacagccctgttcagtggagtctcttgggtgatgaaaattggaataggtgtcctcttgacttggatagggttgaattcaaaaaacacatccatgtcattttcatgcattgcgataggaatcattacactctatctgggagctgtggtacaagctgacatggggtgtgtcataaactggaagggcaaagaactcaaatgtggaagcggaattttcgtcaccaatgaggtccatacttggacagagcaatacaaattccaagcagactccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacacttggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtaaaaacctgcacatggccaaaatcacacactctctggagtaatggtgtgctagagagtgacatgatcatcccaaagagtctagctggtcctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgttgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacatttaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattagtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccacttcttatttttagcttgaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggacgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcaaaagggggaggaggtgcaggttattgccgtagagccagggaagaacccaaagaactttcaaaccatgccaggcacttttcagactactacaggggaaataggagcaattgcattggatttcaagcctggaacttcaggatctcctatcataaatagagagggaaaggtagtgggactgtatggcaatggagtggttacaaagaatggtggctatgtcagcggaatagcgcaaacaaatgcagaaccagatggaccgacaccagagttggaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggttccaaattacaacttgataataatggatgaggcccatttcacagacccagccagtatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggattaccgacttcgctgggaaaacggtgtggtttgtccctagcattaaagccggaaatgacatagcaaactgcttgcgaaaaaacgggaaaaaagtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggccggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggattataccagctctctttgaaccagaaagggagaagtcagccgccatagacggtgagtatcgcctgaagggtgagtccaggaagactttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaacttgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtaatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagagacaacacatcatgccgtgtcccgaggtagcgcaaaacttcaatggtttgtggaaagaaacatggtcgttcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagcggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttactaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacaggcagttagcgaacgctatattcaagctcacataccaaaacaaagtggtcaaagttcaacgaccgactccaacgggcacggtaatggatattatatctaggaaagaccaaaggggcagtggacaagtgggaacttatggcctgaatacattcaccaacatggaagcccagttagtcagacaaatggaaggagaaggtgtgctgacaaaggcagacctcgagaaccctcatctgctagagaagaaaatcacacaatggctggaaaccaaaggagtggagaggttaaaaagaatggccattagcggggatgattgcgtggtgaaaccaatcgatgacaggttcgctaatgccctgcttgctttgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacttgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagtcggagggagccatttggtaa

SEQ ID NO: 1343 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaacctcacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacatgggttgacgtagtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcaataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaaccacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagaaaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaggaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgcttcgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacatcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgcgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaggatttttggaaactagtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1344 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaacattgaggctgaacctccttttggggaaagtaatatagtgattggaattggagacaatgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatatttggaagtgcttacacagccctattcagtggagtctcttgggtaatgaaaatcggaataggagttctcttgacttggatagggttgaattcaaaaaacacatccatgtcattttcatgcattacgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctgaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaattatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaaatctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagtttgaaagacacactcaaaaggagaagctggccactgaatgaaggggtgatggctgttgggcttgtgagcattctagccagttctctccttagaaatgacgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacactgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctatgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgcttcgatggacaacgtaacaatcaaattttagaggagaacatggatgtggaaatctggacaaaggaaggagaaaagaaaaaattgaggcctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgtcgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacaaggtgaaactttaggagaaaaatggaaaaagaaattaaatcaattatcccggaaagagtttgacctttacaagaaatctggaatcactgaagtggatagaacagaagctaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacccatgtccacatatggatggaacatagttaagttaatgagtggaaaggatgtgttttatcttccgcctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatgggaatcacagcggagtggctctggagaaccctgggaaggaacaaaaaacccaggttatgcacaagggaagagttcacaaaaaaggtcagaactaacgcagccatgggcgccgtttttacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacggctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgttgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1345 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaagtgcccccacatcaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtaggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggtttcttgacctacctctaccatggacatcaggagctacaacggaaacaccaacctggaacaggaaggagcttcttgtgacatttaagaacgcacatgcgaagaaacaagaagtagttgtccttggatcacaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatatttggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaagtcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacagcgggaccctggcatttaggaaaattagagctggacttcaactattgtgaaggaacaacagttgtcatcacagaaaactgtgggacaagaggcccagcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctagccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctggtttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacagtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtaacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatatttacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagataggagatggtgctttgatggacaacgtaataatcaaattttagaggagaacatggatgtggaaatctggacaaaggaaggagaaaagaaaaaattaagacctaggtggcttgatgcccgcacttattcagatcccttagcactcaaggaattcaaggactttgcggctggtagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaacaatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggcacacaaggtgaaactttaggagaaaaatggaaaaagaaattaaatcaattatcccggaaagagtttgacctttacaagaaatctggaatcactgaagtggatagaacagaagccaaagaagggttgaaaagaggagaaattacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggaaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaagatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattatacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtaggacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcgggtcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1346 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagtatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcggggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1347 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtattgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacagtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1348 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggtcatggcgttcatagctttcctcagatttctagccatcccaccaacagcaggagtcttggctagatggggaaccttcaagaagtcgggggccatcaaggtcctgaaaggcttcaagaaggagatctcaaacatgctgagcataatcaacaaacgaaaaaagacatcactctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgcaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaagagagacaacacatcacgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacccatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctatccatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1349 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctaaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccggaggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagccattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggtgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1350 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtgggaaacagagattttgtggaaggactatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaacacctttgtgttgaagaaagaagtctcagaaacgcagcatgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaagacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacccatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1351 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtgggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaacacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttgttgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1352 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcatcacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcagcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactataggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctcttagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagctatgggcgccgttttcacagaggagaaccaatgggacagtgcgaaagctgctgttgaggatgaagaattttggaaacttgtggacagagaacgtgcactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1353 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgattttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcatcacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactataggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgttttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttctagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaacccgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1354 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccttacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaatcctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaacgggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacagaagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1355 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaaaaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtactcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggagagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatatttggaagtgcttacacagccctattcagtggagtctcttgggtaatgaaaatcggaataggagttctcttgacttggatagggttgaattcaaaaaacacatccatgtcattttcatgcattacgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctgaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaattatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaaatctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagtttgaaagacacactcaaaaggagaagctggccactgaatgaaggggtgatggctgttgggcttgtgagcattctagccagttctctccttagaaatgacgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacactgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctatgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagaccgtgagtatcgcttgaaaggtgagtccaggaagactttcgtggaactcatgaggaggggtgaccttccagtctggttagcccataaagtagcatcagaagggatcaaatatacagatagaaaatggtgcttcgatggacaacgtaataatcaaattttagaggagaacatggatgtggaaatctggacaaaggaaggagaaaagaaaaaattgaggcctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgtcgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacaaggtgaaactttaggagaaaaatggaaaaagaaattaaatcaattatcccggaaagagtttgaccttaccaagaaatctggaatcactgaagtggatagaacagaagctaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacccatgtccacatatggatggaacatagttaagttaatgagtggaaaggatgtgttttatcttccgcctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatgggaatcacagcggagtggctctggagaaccctgggaaggaacaaaaaacccaggttatgcacaagggaagagttcacaaaaaaggtcagaactaacgcagccatgggcgccgtttttacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacggctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgttgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1356 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgtttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgtcggcatgggactggacacacgcactcaaacctggatgtcggctgaaggagcttggagacaagtcgagaaggtagagacatgggcccttaggcacccagggtttatcatactagccctatttcttgcccattacataggcacttccttgacccagaaagtggttatttttatactattaatgctggttaccccatccatgacaatgagatgtgtgggagtaggaaacagagattttgtggaaggcctatcgggagctacgtgggttgacgtggtgctcgagcacggtgggtgtgtgactaccatggctaagaacaagcccacgctggacatagagcttcagaagaccgaggccactcaactggcgaccctaaggaagctatgcattaagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttacaatcaatagagggaaaagtggtgcaacatgagaacctcaaatacaccgtcatcatcacagtgcacacaggagaccaacaccaggtgggaaatgaaacgcagggagttacggctgagataacatcccaggcatcaaccgctgaagccattttacctgaatatggaaccctcgggctagaatgctcaccacggacaggtttggatttcaatgaaatgattttattgacaatgaagaacaaagcatggatggtacatagacaatggttctttgacttacccctaccatggacatcaggagctacaacagaaacaccaacttggaacaggaaagagcttcttgtgacatttaaaaatgcacatgcaaaaaagcaagaagtagttgtccttggatcacaagagggagcaatgcatacagcactgacaggagctacagagatccaaacctcaggaggcacaagtatttttgcggggcacttaaaatgtagactcaagatggacaaattgaaactcaaggggatgagctatgcaatgtgcttgaatacctttgtgttgaagaaagaagtctccgaaacgcagcatgggacaatactcattaaggttgagtacaaaggggaagatgcaccctgcaagattcctttctccacggaggatggacaagggaaagctcacaatggcagactgatcacagccaatccagtggtgaccaagaaggaggagcctgtcaacattgaggctgaacctccttttggggaaagtaatatagtaattggaattggagacaaagccctgaaaatcaactggtacaggaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttagtggagtctcctggataatgaaaattggaataggtgtcctcttaacctggatagggttgaattcaaaaaacacttctatgtcattttcatgcattgcgataggaatcattacactctatctgggagtcgtggtgcaagctgacatggggtgtgtcataaactggaaaggcaaagaactcaaatgtggaagtggaattttcgtcactaatgaggtccacacctggacagagcaatacaaatttcaagcagactcccccaaaagactggcaacagccattgcaggcgcttgggagaatggagtgtgcggaattaggtcaacaaccagaatggagaacctcttgtggaagcaaatagccaatgaactgaactacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacgaaattcctctttcataatagatgggccaagcacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaagctagaaaaagcatccctcatagaggtgaaaacctgcacatggccaaaatcacacactctttggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaatcagacccattaatgagaaagaagagaacatggtaaagtctctagcctcagcagggagtggaaaggtggacaacttcacaatgggtgtcttgtgtttggcaatcctctttgaagaggtgatgagaggaaaatttgggaaaaaacacatgatcgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccattcttggctttgggattcttcctgaggaaactgacatctagagaaaatttattgctgggagttgggttggccatggcagcaacgttacgactgccagaggacattgaacaaatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagttccacccctaccactttttattttcagtctgaaagatacactcaaaaggagaagctggccactgaatgagggggtgatggcagttggacttgtgagcattctagctagttctctccttaggaatgatgtgcccatggctggaccattagtggctgggggcttgctgatagcgtgctacgtcataattggcacgtcagcagacctcactgtagaaaaagcagcagatgtaacatgggaggaagaggccgagcaaacaggagtgtcccacaatttaatgatcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcacgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcatttttcagacaacaacaggggaaataggagcaattgcactggacttcaagcctggaacttcaggatctcccatcataaacagagagggaaaggtagtgggactgtatggcaatggagtggttacaaagaatggaggctatgttagtggaatagcgcaaacaaatgcagaaccagatggaccgacaccagagttggaagaagagatgttcaaaaagcgaaaactaaccataatggatcttcatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggctcatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggtcattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaaagatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcgtcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtccctggcagccatagctaaccaggcagtggtcctgatgggtttagacaaaggatggccgatatcgaaaatggacttgggcgtaccactattggcactgggttgctattcacaagtgaacccactaactcttatagcggcagtacttttgctagtcacacattatgcaattataggtccaggattgcaggcaaaagccactcgtgaagctcagaaaaggacagctgctggaataatgaagaatccaacggtggatggaataatgacaatagacctagatcctgtaatatatgattcaaaatttgaaaagcaactaggacagattatgctcctggttctgtgtgcagttcaacttttgttaatgagaacatcatgggccttgtgtgaagctctaaccctagccacaggaccaataacaacactctgggaaggatcacctgggaagttctggaacaccacgatagctgtctccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcccgaaggaagagtcatagacttaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagtcttgaagatggttgaaccatggctaaaaaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaacatcgtctcttcagtcaacatggtatccagattgctactgaacagattcacaatgacacacaggagacccaccatagagaaagatgtggatttaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccatttggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggagttcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggtagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggagaggttaaaaagaatggccatcagcggggatgattgcgtagtgaaaccaatcgacgacagattcgccaatgccctgcttgccctgaacgatatgggaaaggttaggaaggacatacctcaatggcagccatcaaagggatggcatgattggcaacaggtccctttctgctcccaccactttcatgaattgatcatgaaagatggaagaaagttggtagttccctgcagaccccaggacgaactaataggaagagcgagaatctctcaaggagcaggatggagccttagagaaactgcatgtctagggaaagcctacgctcaaatgtggactctcatgtattttcacagaagagatcttagactagcatccaacgccatatgttcagcagtaccagtccattgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctaggaaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 1357 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactataggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtcccaagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1358 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaagaactgctgaacggccagggaccaatgaaattggtcatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaatgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaggggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaactctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccacttccatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1359 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccatcccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagagtgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcttgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgccctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgatcttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcctacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcacgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaatccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctatccatgctcaccatcagtggatgactacagaagacatgcttactgtttggaacagggtgtggatagaggaaaatccatggatggaagacaaaactccagttacaacctgggaaaatgttccttatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1360 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccttggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatgcagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctatccatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1361 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggctgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatgcagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctatccatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1362 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagcggagtctcttgggtgatgaaaattggaataggtgtcctcttgacttggatagggttgaattcaaagaacacatccatgtcattttcatgcattgcgataggaatcattacactctatctgggagctgtggtacaagctgatatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcctgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagttgacatctagagaaaatttattgttaggagttgggttggccatggcaacaacgttacaactgccagaggacattgaacaaatggcaaatggaattgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaagaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcagctggcagaaagtcaatcgcccttgatcttgtgacagaaataggaagagtgccttcacatctagcccacagaacaagaaacgctctggataatctagtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagacagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaatcacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1363 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacagaaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccggaggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccaacagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1364 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacagaaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaaaaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccggaggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtacgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccaacagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1365 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaaaaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagcggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcctgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaattgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcttttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaagaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcagctggcagaaagtcaatcgcccttgatcttgtgacagaaataggaagagtgccttcacatctagcccacagaacaagaaacgctctggataatctagtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagacagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaatcacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1366 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacagaaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccggaggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtacgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccaacagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1367 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaagaactgctgaacggccagggaccaatgaaattggtcatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaatgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaataaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaggggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaactctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggcctcaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccacttccatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1368 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagttggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatgcagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctatccatgctcaccatcagtggatgactacagaagacatgctttctgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1369 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatctagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatgcagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctatccatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1370 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactataggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgagagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaattgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtcttcaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattgcacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1371 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacagaaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccggaggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataagataaaacaacaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacattatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccaacagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1372 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggactgagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattagcggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccggaggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtctcaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaaaggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctatatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1373 - DNA, 10173 bp, Dengue virus
atgaacaaccaacggaagaagacgggaaaaccgtctatcaatatgctgaaacgcgtgagaaaccgtgtgtcaactggatcgcagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcctgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtctcacaacttaatgatcacagttgatgatgatggaacaatgagaataaaagatgatgagactgagaacatcctaacagtgcttttgaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaagaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctagtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacctaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaagcatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1374 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagcggagtctcttgggtgatgaaaattggaataggtgtcctcttgacttggatagggttgaattcaaagaacacatccatgtcattttcatgcattgcgataggaatcattacactctatctgggagctgtggtacaagctgatatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcctgggtactacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagttgacatctagagaaaatttattgttaggagttgggttggccatggcaacaacgttacaactgccagaggacattgaacaaatggcaaatggaattgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaagaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcagctggcagaaagtcaatcgcccttgatcttgtgacagaaataggaagagtgccttcacatctagcccacagaacaagaaacgctctggataatctagtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagacagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaatcacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1375 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggtcatggcgttcatagctttcctcagatttctagccatcccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgcaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaagagagacaacacatcacgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacccatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctatccatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1376 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcattcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaagacatcgctctgtctcatgatgatgttaccagcaacacttgctttccacttaacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtagagcctgaagacattgactgctggtgcaacctcacatcgacgtgggtgacctacggaacgtgcaaccaagctggagagcatagacgcgataagagatcggtggcgttagctcctcacgtcggcatgggactggacacacgcgcccaaacctggatgtcggctgagggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagccacgtgggttgacgtggtgctcgaacatggtgggtgtgtgaccaccatggctaagaacaagcccacgctggacatagagctccagaagaccgaggccacccaactggcaaccttaaggaaactatgcattgagggaaaaatcaccaacgtgacaaccgactcaaggtgccccacccaaggggaagcgattctacctgaggagcaggaccagaactacgtgtgtaagcacacatacgtggacagaggttggggaaacggttgtggtttgtttggcaagggaagcttggtaacatgcgcaaaattccaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcacctcggacaggtctggatttcaatgaaatgattttgttgacaatgaagaacaaagcatggatggtacatagacaatggttttttgacctacctttaccatggacatcaggggctacaacagaaacaccaacctggaataagaaagagcttcttgtgacattcaaaaacgcacacgcaaaaaaacaagaagtagttgtccttggatcgcaagagggagcaatgcacacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggagaagacgcaccttgcaagattcctttctccacggaggatggacaagggaaagcccacaatggcagactgatcacagctaacccagtggtgaccaagaaggaggaacctgtcaatattgaggcagaacctccttttggggaaagtaacataataattggaactggagacaaagccttgaaaatcaattggtacaagaagggaagctcgattgggaaaatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccatcgcaggcgcctgggagaatggagtgtgcggaatcaggtcgacaaccagaatggagaacctcttgtggaagcaaatagccaatgaactaaactacatattatgggaaaacaacatcaaattgacggtagttgtgggtgatataattgggatcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacggcttcggagtcttcacaaccaatatatggctgaaactccgagaaatgtacacccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaaaagtctggctggtcctatctcgcaacacaattacaggcctggataccacacccaaacggcaggaccatggcacctaggaaaattggagctggacttcaactattgcgaaggaacaacagttgtcatcacagaaaattgtgggacaagaggcccatcactgaggacaacaacagtgtcagggaagttgatacacgaatggtgttgccgctcgtgtacacttcctcccctgcgatatatgggagaagacggctgctggtatggcatggaaattagacccattaatgagaaagaagagaatatggtaaagtctttagtctcagcagggagtggaaagatggataacttcacaatgggtgtcttgtgtcttgcaatcctctttgaagaggtaatgagaggaaaattcgggaaaaagcacatgattgcaggggttttcttcacatttgtgctccttctctcagggcaaataacatggagagacatggcgcgcacactcataatgattggatccaacgcctctgacagaatgggaatgggcgttacttacctagcattgattgcaacatttaaaattcagccatttttggctttgggattcttcctgaggaaactgacatccagagaaaatttattattgggagttgggttggccatggcaacaacgttgcaactgccagaggacattgaacaaatggcgaatggaatagccttggggctcatggctctcaaattgataacacaatttgaaacataccaactatggacggcattagtctccctaatgtgtgcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttatttttagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacactcttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccaccccgggtcaggaaagacgcggaaataccttccagctatagttagagaggcaatcaagagacgcttaaggactctaattttggcaccaacaagggtggttgcagctgagatggaagaagcattgaaggggctcccaataaggtatcaaacaactgcaacaaaatctgaacacacagggaaagagattgttgatctaatgtgccacgcaacgttcacaatgcgtttgctgtcaccagtcagagttccaaactacaacttgataataatggatgaggctcatttcacagatccagccagcatagcggctagagggtacatatcaactcgtgtaggaatgggagaggcagccgcaattttcatgacagctacacctcctggaacagctgatgcctttcctcagagcaacgcaccaattcaagatgaagaaagagacataccagaacgctcatggaattcaggcaatgattggattaccgactttcccggaaagactgtgtggtttgtccccagcattaaagctgggaatgacatagcaaactgcttgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcctcttaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagctcataaagtagcatcagaaggaatcaaatacacagacagaaaatggtgttttgatggagagcgcaacaatcaaattttagaggagaacatggatgtggaaatctggacaaaggaaggagaaaagaaaaaattgaggcccaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcacgcagtggaggaattaccagaaacaatggaaacactcttactcctgggactcatgatcctgttaacaggtggggcgatgcttttcttgatatcaggcaaaggagttggaaagacttcaataggactcatttgtgtagttgcttccagcggcatgttatggatggctgatatcccactccaatggattgcgtcggccatagtcctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgcttcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggacgggataatgacaatagacctagatcctgtaatatacgattcaaaatttgaaaagcaactaggacaagttatgctcctggtcctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaaaaaatccggaatcactgaagtggatagaatagaagccaaagaagggttgaaaagaggagaaataacacaccatgccgtatccagaggcagcgcaaaacttcaatggttcgtggagagaaacatggtcattcctgaaggaagagtcatagacctgggctgtggaagaggaggctggtcatattattgtgcaggattgaaaaaagttacagaagtgcgaggatacacaaaaggcggcccaggacatgaagagccagtacctatgtctacatatggatggaacatagtcaagctgatgagtggaaaggatgtgttttatcttccacctgaaaagtgtgacactctattgtgtgacattggagaatcttcaccaagcccaacagtggaggagggcagaaccataagagtcttgaaaatggttgaaccatggctaaaaaacaaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggaaacccaccatagagaaagatgtggatttaggagcggggacccgacatgtcaatgcggaaccagaaacgcccaacatggatgtcattggggaaagaataagaaggatcaaggaggagcatagttcaacatggcactatgatgatgaaaatccttacaagacgtgggcttaccatggatcatatgaagttaaggccacaggctcagcctcctccatgataaatggagtcgtgaaactcctcacgaaaccatgggatgtggtgcccacggtgacacagatggcaatgacggacacgaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagacatttccaagatacccggaggagctatgtatgctgatgacacagctgggtgggacacaagaataacagaagatgacctgcacaatgaggaaaaaatcacacagcaaatggatcctgaacacaggcagttagcaaacgctatatttaagctcacataccaaaacaaagtggtcaaagttcaacgaccaactccaaagggcacggtgatggacatcatatctaggaaagaccaaagaggcagtggacaggtgggaacttatgggctgaatacattcaccaacatggaagcccagttgatcagacaaatggaaggagaaggtgtgttgtcgaagacagacctagagaaccctcacctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcaagattggcaacaggtccctttctgctcccaccactttcatgaattgattatgaaagatggaagaaagttggtggtcccctgcagacctcaggatgaattaatagggagagcgagaatctctcagggagcaggatggagccttaaagaaactgcatgcctagggaaagcctacgctcaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgtggatcactcattggtctcacttccagagcaacctgggcccagaacatacttactgcaatccaacaggtaagaagccttataggcaatgaagagtttctggactacatgccttcgatgaagagattcaggaaggaggaggagtcagagggagccatttggtaa

SEQ ID NO: 1377 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactataggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactgcaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1378 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctatccatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1379 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaagaactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacacagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaactctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1380 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaacggctgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1381 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactataggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctagatggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1382 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaagaactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgttggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaactctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1383 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctacaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1384 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactataggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1385 - DNA, 10173 bp, Dengue virus; identical to SEQ ID NO: 1358

SEQ ID NO: 1386 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaagaactgctgaacggccagggaccaatgaaattggtcatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcatggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaatgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaggggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaactctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaggcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccacttccatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1387 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaagaactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaactctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1388 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaatggccaaggaccaatgaaattggttatggcattcatagctttcctcagatttctagccattccaccgacagcgggaatcttggctagatggggaaccttcaagaagtcgggggctattaaggtcctgagaggcttcaagaaggagatctcaaatatgctgagcattatcaacagacggaaaaagacatcgctctgtctcatgatgatgttaccagcaacacttgctttccacttaacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtagagcctgaagacattgactgctggtgcaacctcacatcgacgtgggtgacctacggaacgtgcaaccaagctggagagcatagacgcgataagagatcggtggcgttagctcctcacgtcggcatgggactggacacacgcgcccaaacctggatgtcggctgagggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagccacgtgggttgacgtggtgctcgaacatggtgggtgtgtgaccaccatggctaagaacaagcccacgctggacatagagctccagaagaccgaggccacccaactggcaaccttaaggaaactatgcattgagggaaaaatcaccaacgtgacaaccgactcaaggtgccccacccaaggggaagcgattctacctgaggagcaggaccagaactacgtgtgtaagcacacatacgtggacagaggttggggaaacggttgtggtttgtttggcaagggaagcttggtaacatgcgcaaaattccaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcacctcggacaggtctggatttcaatgaaatgattttgttgacaatgaagaacaaagcatggatggtacatagacaatggctttttgacctacctttaccatggacatcaggggctacaacagaaacaccaacctggaataagaaagagcttcttgtgacattcaaaaacgcacacgcaaaaaaacaagaagtagttgtccttggatcgcaagagggagcaatgcacacagcactgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggagaagacgcaccttgcaagattcctttctccacggaggatggacaagggaaagcccacaatggcagactgatcacagctaacccagtggtgaccaagaaggaggaacctgtcaatattgaggcagaacctccttttggggaaagtaacataataattggaactggagacaaagccttgaaaatcaattggtacaagaagggaagctcgattgggaaaatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccatcgcaggcgcctgggagaatggagtgtgcggaatcaggtcgacaaccagaatggagaacctcttgtggaagcaaatagccaatgaactaaactacatattatgggaaaacaacatcaaattgacggtagttgtgggtgatataattgggatcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacggcttcggagtcttcacaaccaatatatggctgaaactccgagaaatgtacacccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaaaagtctggctggtcctatctcgcaacacaattacaggcctggataccacacccaaacggcaggaccatggcacctaggaaaattggagctggacttcaactattgcgaaggaacaacagttgtcatcacagaaaattgtgggacaagaggcccatcactgaggacaacaacagtgtcagggaagttgatacacgaatggtgttgccgctcgtgtacacttcctcccctgcgatatatgggagaagacggctgctggtatggcatggaaattagacccattaatgagaaagaagagaatatggtaaagtctttagtctcagcagggagtggaaagatggataacttcacaatgggtgtcttgtgtcttgcaatcctctttgaagaggtaatgagaggaaaattcgggaaaaagcacatgattgcaggggttttcttcacatttgtgctccttctctcagggcaaataacatggagagacatggcgcgcacactcataatgattggatccaacgcctctgacagaatgggaatgggcgttacttacctagcattgattgcaacatttaaaattcagccatttttggctttgggattcttcctgaggaaactgacatccagagaaaatttattattgggagttgggttggccatggcaacaacgttgcaactgccagaggacattgaacaaatggcgaatggaatagccttggggctcatggctctcaaattgataacacaatttgaaacataccaactatggacggcattagtctccctaatgtgtgcaaacacaattttcacgttgactgttgcctggagaacagccaccctgattttggccggaatttcgcttttgccagtgtgccagtcttcgagcatgaggaaaacagattggctcccaatgactgtggcagctatgggagttccacctctaccactttttatttttagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacactcttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccaccccgggtcaggaaagacgcggaaataccttccagctatagttagagaggcaatcaagagacgcttaaggactctaattttggcaccaacaagggtggttgcagctgagatggaagaagcattgaaggggctcccaataaggtatcaaacaactgcaacaaaatctgaacacacagggaaagagattgttgatctaatgtgccacgcaacgttcacaatgcgtttgctgtcaccagtcagagttccaaactacaacttgataataatggatgaggctcatttcacagatccagccagcatagcggctagagggtacatatcaactcgtgtaggaatgggagaggcagccgcaattttcatgacagctacacctcctggaacagctgatgcctttcctcagagcaacgcaccaattcaagatgaagaaagagacataccagaacgctcatggaattcaggcaatgattggattaccgactttcccggaaagactgtgtggtttgtccccagcattaaagctgggaatgacatagcaaactgcttgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcctcttaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagctcataaagtagcatcagaaggaatcaaatacacagacagaaaatggtgttttgatggagagcgcaacaatcaaattttagaggagaacatggatgtggaaatctggacaaaggaaggagaaaagaaaaaattgaggcccaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcacgcagtggaggaattaccagaaacaatggaaacactcttactcctgggactcatgatcctgttaacaggtggggcgatgcttttcttgatatcaggcaaaggagttggaaagacttcaataggactcatttgtgtagttgcttccagcggcatgttatggatggctgatatcccactccaatggattgcgtcggccatagtcctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgcttcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggacgggataatgacaatagacctagatcctgtaatatacgattcaaaatttgaaaagcaactaggacaagttatgctcctggtcctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaaaaaatccggaatcactgaagtggatagaatagaagccaaagaagggttgaaaagaggagaaataacacaccatgccgtatccagaggcagcgcaaaacttcaatggttcgtggagagaaacatggtcattcctgaaggaagagtcatagacctgggctgtggaagaggaggctggtcatattattgtgcaggattgaaaaaagttacagaagtgcgaggatacacaaaaggcggcccaggacatgaagagccagtacctatgtctacatatggatggaacatagtcaagctgatgagtggaaaggatgtgttttatcttccacctgaaaagtgtgacactctattgtgtgacattggagaatcttcaccaagcccaacagtggaggagggcagaaccataagagtcttgaaaatggttgaaccatggctaaaaaacaaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggaaacccaccatagagaaagatgtggatttaggagcggggacccgacatgtcaatgcggaaccagaaacgcccaacatggatgtcattggggaaagaataagaaggatcaaggaggagcatagttcaacatggcactatgatgatgaaaatccttacaagacgtgggcttaccatggatcatatgaagttaaggccacaggctcagcctcctccatgataaatggagtcgtgaaactcctcacgaaaccatgggatgtggtgcccacggtgacacagatggcaatgacggacacgaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagacatttccaagatacccggaggagctatgtatgctgatgacacagctgggtgggacacaagaataacagaagatgacctgcacaatgaggaaaaaatcacacagcaaatggatcctgaacacaggcagttagcaaacgctatatttaagctcacataccaaaacaaagtggtcaaagttcaacgaccaactccaaagggcacggtgatggacatcatatctaggaaagaccaaagaggcagtggacaggtgggaacttatgggctgaatacattcaccaacatggaagcccagttgatcagacaaatggaaggagaaggtgtgttgtcgaagacagacctagagaaccctcacctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcaagattggcaacaggtccctttctgctcccaccactttcatgaattgattatgaaagatggaagaaagttggtggtcccctgcagacctcaggatgaattaatagggagagcgagaatctctcagggagcaggatggagccttaaagaaactgcatgcctagggaaagcctacgctcaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgtggatcactcattggtctcacttccagagcaacctgggcccagaacatacttactgcaatccaacaggtaagaagccttataggcaatgaagagtttctggactacatgccttcgatgaagagattcaggaaggaggaggagtcagagggagccatttggtaa

SEQ ID NO: 1389 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacatcaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatgggttgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcgtatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1390 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacataggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctttggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggcaagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtctccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctatacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1391 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacgaaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatctctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacctctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctggatcaggaaagacacggaaataccttccagctattgtcagggaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgtctttcctcagagcaatgccccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaagatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaagaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacagacagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1392 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctacttttcaagacagcttctggaatcaacatgtgcacactcatagccatggatctgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtagcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatactattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcagttttgcctgaggagcaggaccagaactacgtgtgtaagcatacctacgtagacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggattttaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgtttgaggccactgccaggggcgcaaggcgcatggccatcttgggagacacagcttgggactttggatcagtaggtggtgttctgaactcattaggcaaaatggtgcaccaaatatttggaagtgcctacacagccctgttcagtggagtctcttgggtgatgaaaattggaataggtgtcctcttgacttggatagggttgaattcaaagaacacatccatgtcattttcatgcattgcgataggaatcattacactctatctgggagctgtggtacaagctgacatggggtgtgtcataaactggaagggcaaagaactcaaatgtgggagcggaattttcgtcaccaatgaggtccatacctggacagagcaatacaaattccaagcagattccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacaattggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggaatgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacacactctctggagtaatggtgtgctagagagtgacatgatcatcccaaagagtctagctggacctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggagtcttgtgtttggcaatcctctttgaagaggtgatgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacattcaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattggtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccactttttatttttagcttgaaagacacacttaaaaggagaagctggccactgaatgaaggagtgatggctgttgggcttgtgagcattctggccagttctctccttagaaatgacgtacccatggctggaccattagtggccgggggcttgctgatagcgtgctacgttataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggatgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcagaagggggaggaggtgcaggttattgccgtagagccagggaagaacccaaagaactttcaaaccatgccaggcacttttcagactactacaggggaaataggagcaattgcactggatttcaagcctgggacttcaggatctcctatcataaatagagagggaaaggtagtgggactgtatggcaatggagtggttacaaagaatggtggctatgtcagcggaatagcgcaaacaaatgcagaaccagatggaccgacaccagagttagaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggtcccaaattacaacttgataataatggatgaggcccatttcacagacccagccagcatagcggctagagggtacatatcaactcgtgttggaatgggagaagcagccgcaatcttcatgacagcaacaccccctggaacagctgatgcctttcctcagagcaatgctccaatccaagatgaagaaagggacataccagaacgctcatggaattcaggcaatgaatggattaccgacttcgctgggaaaacggtgtggtttgtccctagcattaaagccggaaatgacatagcaaactgcttgcggaaaaacgggaaaaaggtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggataataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacatctagcccacagaacaagaaacgctctggataatctggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtgatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtagatagaacagaagccaaagaagggctgaaaagaggagagacaacacatcatgccgtgtcccgaggtagcgcaaaactccaatggtttgtggaaagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagtggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggagagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacaggcagttagcgaacgctatattcaagctcacataccaaaacaaagtggtcaaagttcaacgaccgactccaacgggcacggtaatggacattatatctaggaaagaccaaaggggcagtggacaagtgggaacttatggccttaatacattcaccaacatggaagcccagttagtcagacaaatggaaggagaaggtgtgctgacaaaggcagacctcgagaaccctcatctgctagagaagaaaattacacaatggttggaaaccaaaggagtggagaggttaaaaagaatggccattagcggggatgattgcgtggtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacctgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagttggagggagccatttggtaa

SEQ ID NO: 1393 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggtcaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataagtgccccctcattgctgaagtggaaccagaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagagcaagcctacgctggacatagagcttcaaaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggacagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagttacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccaccgccagaggtgcaaggcgaatggccatcttgggagacacagcctgggactttggttcagtgggtggtgttctaaattcattagggaaaatggtgcaccaaatattcggaagtgcttacacagccctgtttagcggagtctcttggataatgaaaattggaataggtgtccttttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtccyatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtatcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacctagccccccagaaacacagaaagcagaactggaagagggggtctataggatcaaacaacaaggaatttttgggaaaacccaggtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaatccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaactgacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagccccttaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccatagaacgagaaacgccctggacaacttggtgatgctgcacacgtcagaacatggcggtagggcctacagacatgcagtagaggaactaccagaaacaatggaaacactcctactcttgggactcatgatcttattaacaggtggagcaatgcttttcttgatatcgggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagatcagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaggaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaatatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcttcctccatgataaatggagtcgtgaaactcctcacaaaaccatgggatgtggttcccatggtgacacagatggcaatgacagatacaactccatttgggcagcaaagagtcttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaatatgatgggcaagagagagaaaaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcatacaatggttggaaaccaaaggagtggagagattaaaaagaatggccatcagcggggatgattgcgtggtgaaaccgatcgatgacaggtttgccaatgccctgcttgccttgaacgacatgggaaaggtcaggaaggacataccccaatggcagccatcaaaggggtggcatgattggcaacaggtccctttctgctcccaccactttcatgaactgatcatgaaagatggaagaaagctggtggttccctgcagaccccaggacgaactaataggaagggcgagaatctctcaaggagcaggatggagccttaaagaaactgcatgcctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctttctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1394 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcgagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgattgtggggaagaatgaaagagggaaatccttacttttcaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggccgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccaccatggctaagaacaagcctacgctggacatagagcttcagaagaccgaggccacccaactggcaaccctaaggaagttatgcattgaagggaaaattaccaacataacaactgactcaaggtgtcctacccaaggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcagtggttctttgacctacccctaccatggacatcaggagctacaacagagacaccaacttggaacaggaaagagcttcttgtgacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttagatacctttgtgttgaagaaagaagtctctgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaactcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaacctattgtggaagcaaatagccaatgagctgaactacatattatgggaaaacaacatcaaattaacggtagttgtgggtgacgtaattggggtcttagagcaagggaaaagaacactaacaccacagcccatggagctaaaatattcatggaaaacatggggaaaggcaaaaatagtgacagctgaaacacaaaattcctctttcataatagatgggctaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactggagagtgacatgatcatcccaaagagtctagctggtcctatttcacaacataaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacagaatgggaatgggcgttacctacttagctttaattgcaacattcaaaatccagccattcttggctttgggattcttcctgaggaagttgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagtttcacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatctttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcggctgagatggaagaagcactgaaaggactcccaataaggtatcaaacaactgcaacaaaatctgaacacacaggaagggagattgttgatctaatgtgccacgcaacattcacaatgcgcttgttatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgatgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatatacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgaccttgtgacagaaataggaagagtgccttcacacttagcctacagaacgagaaacgccctggacaacttggtgatgctgcacacatcagaacatggcggtagggcttacaggcatgcagtggaggaactaccagaaacaatggaaacactcctactcttgggactcatgatcttattaacaggtggagcaatgcttttcttgatatcaggcaaagggattggaaagacttcaataggactcatttgtgttattgtttccagtggcatgctatggatggctgatatcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagagacaacacatcatgccgtgtccagaggcagcgcaaaacttcaatggttcgtggagaggaacatggtcattcccgaaggaagggtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatacggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaacccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgtttttacagaggagaaccaatgggatagcgcgagagctgctgttgaagacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagatcactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaggaaactgcatgtctagggaaagcctacgctcaaatgtggagtctcatgtatttccacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagtcttataggcgatgaagaatttctggactacatgccttcgatgaagagattcaggaaggaggaggagtcagagggagccatttggtaa

SEQ ID NO: 1395 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctggccattccaccgacagcaggagtcttggctagatggggaaccttcaagaagtcgggggctattaaggtcctaaaaggcttcaagaaggagatttcaaacatgctgagcataatcaacaaaaggaaaaagacatcgctctgcctcataatgatgttaccagcaacacttgctttccacctgacttcacgcgatggagagccgcgcatgattgtggggaagaatgaaagagggaaatccttactttttaagacagcttccggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagctaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgcgataggaattatcacactctatctgggagctgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgggaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctaccaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgctacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggagcagtactgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcattgaagggactcccaataaggtatcaaacaactgcaacaaaatctgaacacacaggaagggagattgttgatctaatgtgccatgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgttagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgcttcgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttgggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagttacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagattcacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggacagcgcaagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagcctcataggcgatgaagaatttctggactacatgccttcgatgaagagattcaggaaggaggaggagttagagggagccatttggtaa

SEQ ID NO: 1396 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggtcatggcgttcatagctttcctcagatttctagccattccaccaacagcaggagtcttggctagatggggaaccttcaagaagtcaggggctattaaggtcctaaaaggcttcaagaaggagatttcaaacatgctgagcatcatcaacaaaaggagaaagacgtcactctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagaaatgtgtgatgacacggtcacttataaatgccccctcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggatacacgtacccaaacctggatgtcggctgaaggagcttggagacaagttgaaaaggtagagacatgggctcttaggcacccaggtttcaccatactagctctatttcttgcccattacataggcacttccctgacccagaaagtggttattttcatactactaatgctggtcactccatccatgacaatgagatgcgtgggagtaggaaacagagattttgtggaaggtctgtcaggagcaacgtgggttgatgtggtgcttgagcacggtgggtgtgtgaccaccatggctaagaacaagcctacgctggacatagagcttcagaagaccgaggccactcaactggcgaccctaaggaagttatgcattgagggaaaaattaccaacataacaactgactcaaggtgtcctacccagggggaagcgactttacctgaggagcaggaccagaactacgtatgtaagcacacatacgttgatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtggttgtccttggatcgcaagagggagcaatgcacacagcgctgacaggagctactgagatccaaaactcaggaggaacaagcatctttgcggggcacttgaaatgtagacttaagatggacaaattggaactcaaggggatgagctatgcaatgtgcttgaatacctttgtgctgaagaaagaagtctccgaaacgcagcatgggacaatactcatcaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccaaaggtgcaaggcgcatggccatcttaggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggataggattgaattcaaaaaacacttccatgtcattttcatgcattgtgataggaattattacactctacctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggagcttgggaaaatggagtttgtggaatcaggtcaacaaccagaatggaaaatctattgtggaagcaaatagctaatgagctaaactacatattatgggaaaacaacatcaaattaacagtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcacgccgacatgggctattggatagaaagccaaaagaatggaagttggaagctagaaaaagcatccttcatagaggtaaaaacctgtacttggccaaaatcacacactctttggagcaatggtgtactagagagtgacatgatcatcccaaagagtttagctggtcctatttcacaacacaaccacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacatgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagttctatgtttggcaatcctcttcgaagaggtgatgagaggaaaatttgggaagaaacacatgattgcaggggttctctttacatttgtgctccttctctcagggcaaataacatggagagatatggcacacacactcataatgattgggtccaacgcttctgacaggatggggatgggcgttacctacttagctttaattgcaacattcaaaatccagccattcttggctttgggattcttcctgaggaaattgacatctagagaaaatttgctgttgggagttgggttggccatggcaacaacgttgcaactgccagaggacattgaacaaatggcgaatggaattgccctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggtggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgctggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagagagaaggagtcttccacactatgtggcacgtcacaagaggggcagtattgacgcacaatgggaaaagactggaaccaaactgggccagcgtgaaaaaagatctgatttcatacggaggaggatggagattgagcgcgcaatggcaaaagggagaggaggtgcaggttattgccgtagagcctgggaaaaaccccaaaaactttcaaaccatgccgggcacttttcagacaacaacgggggaaataggagcaattgcactagacttcaagcctggaacttcaggatctcctatcataaacagagagggaaaagtagtgggactgtatggcaatggagtggtcacaaaaaatggtggttacgtcagtggaatagcgcaaacaaatgcagaaccagatggaccgacaccggaattggaagaagaaatgttcaaaaagcgaaatttaaccataatggatcttcaccctgggtcagggaagacgcggaaatatcttccagccattgtcagagaagcaattaagagacgcttaagaactctaattttggcaccaacaagagtggttgcagctgagatggaagaagcactgaaaggacttccaataaggtatcaaacaactgcaacaaaatctgaacacacaggaagggagattgttgatctaatgtgccacgcaacattcacaatgcgcttgttatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaactcgggcaatgaatggattaccgactttgttgggaagacggtgtggtttgtccctagcatcaaagccggaaatgacatagcaaactgcctgcggaaaaatgggaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacctgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgttagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccctcacacttagcccacagaacgagaaacgccctggacaatttggtgatgctgcacaagtcagaacatggcggtagggcctacaggcatgcagtggaggaactaccagaaacaatggaaacactcctactcttgggactcatgatcttattaacaggtggagcaatgcttttcctgatatcaggcaaagggattggaaagacttcaatgggactcatttgtgttattgtttccagcggcatgttatggatggctgatgtcccacttcaatggatcgcgtcggctatagtcttggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaactagctatttagatgtagacttgcacccagcatcagcctggacgctgtacgccgtggccacaacagtaataacaccaatgttgagacataccatagagaattccacagcaaatgtgtccctggcagccatagctaaccaggcagtggtcctgatgggtttagacaaaggatggcctatatcgaaaatggacctaggcgtaccgctactggcactgggctgctattcacaagtgaacccactgactctcacagcagcagtacttctgctagttacacattatgccattataggtccaggactgcaggcaaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctgggaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaactccaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaaaatggttgagccatggctaaaaaacaaccagttttgcattaaagtattaaacccttacatgccaactgtgattgagcacctagaaagactacaaagaaaatatggaggaatgcttgtaagaaacccactctcacgaaactctacgcatgaaatgtactggatatccaatggtaccggcaacatcgtctcttcagtcaacatggtatccagattgctactgaacagattcacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgagctccacaaattgggtaagtgtggaagctgcgtctacaacatgatgggcaagagagagaagaaacttggagagtttggcaaagcaaaaggcagtagagctatatggtacatgtggttgggagccaggtacctcgagttcgaagcactcggatttttaaatgaagaccactggttctcacgtgaaaactcttacagtggagtagaaggagaaggactgcacaagctgggatatattttaagggacatttctaagatacccggaggagccatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagagaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactgataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagcccattggatccctacgagcagaacgacatggtctatccacgctcaccatcagtggatgactacagaagacatgcttactgtctggaacagggtgtggatagaggacaatccatggatggaagacaaaactccagtcacaacttgggaagatgttccatacctagggaaaagagaagatcaatggtgcggatcactcattggtctcacttccagagcaacctgggcccagaacatactcacagcaatccaacaggtgagaagcctcataggcgatgaagaatttctggactacatgccttcgatgaagagattcaggaaggaggaggagtcagagggagccatttggtaa

SEQ ID NO: 1397 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttacaaatgccccctcgttgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccaaggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaagaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaatcaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactccccgaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaactgacatctagagaaaatttgttgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcactctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaataatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaattgagacctaggtggcttgatgcccgcacttattcagatcccttagcacttaaggaattcaaggattttgcagctggcagaaagtcaatcgcctttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggtatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactagcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaataggaaggagaggaacggggtcacaaggcgaaaccttgggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggttgtggaagaggaggctggtcatattattgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtgccagtccattggatccctacaagcagaacgacatggtctattcacgctcaccatcagtggatgaccacagaagacatgctaactgtctggaacagggtgtggatagaggacaatccatggatggaagacaaaactccagttacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1398 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaaaaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcagctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccaaggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgttatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcactgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcgaaaaagcaagaagtggttgtccttggatcgcaagagggagcaatgcacacagcgctgacaggagccacagagattcaaaactcaggaggtacaagcatctttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagcggagtctcatggataatgaaaattggaataggtgtcctcttaacctggatagggttgaattcaaaaaatacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacacaattggggtcttagagcaagggaaaagaacattaacaccacagcctatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaaactagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctatgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaatgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacataccagttgtggacggcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccgctgtttatcttcagcttgaaggacacaccaaaaaggaggagctggccactgaatgagggagtgatggctgttgggcttgtgagcattctagctagctctctccttaggaatgatgtgcccatggctggaccactagtggccgggggcttgttgatagcgtgctatgtcataactggcacgtcagcagacctcactgtagaaaaggcagcagacgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatatggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagtaacgctccaattcaagatgaagaaagggatattccggaacgctcatggaattcaggtaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccagactgaatgactgggacttcgtggtgacaacagacatttcagaaatgggagctaactttaaagcagatagagtgattgacccaagaagatgtctcaagccagtaattttgacagatggacccgagcgagtgatcctggctggaccaatgcctgtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgttgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattctagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatatgtgttattgtttccagtggcatgttatggatggctgatgtcccactccaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaaccacaaagagagacttaggaatgtctaaagaaccaggtgttgtttctccaaccagctatttagatgtagacttgcacccagcatcagcctggacattgtatgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggcgtaccgctattggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggacagaacagaagccaaagaagggttgaaaagaggagaaacaacacatcatgccgtgtccagaggcagcgcaaaacttcaatggttcgtggagaggaacatggtcattcccgaaggaagagtcatagacctaggctgtggaagaggaggctggtcatattactgtgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccctacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcaccaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctataatatgatgggcaagagagagaagaaacttggagagtttggtaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagcttacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaatcctcatctgctagagaagaaaatcacacaatggttggaaaccaaaggagtggagagattaaaaagaatggccatcagcggagatgattgcgtggtgaaaccgattgatgacaggtttgccaacgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggataatccatggatggaagacaaaactccagtcacaacttgggaagatgttccatacctagggaagagagaagatcaatggtgcggatcactcattggtctcacttccagagcaacctgggcccagaacatactcacggcaatccaacaggtgaggagccttataggcgatgaagaatttctggactacatgccttcaatgaagagattcaggaaggaggaggagtcagagggagccatttggtaa

SEQ ID NO: 1399 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcattcatagctttcctcagatttctagccattccaccaacagcaggagtcttggctagatggggaaccttcaagaagtcaggggctattaaggtcctaaaaggcttcaaaaaggagatttcaaacatgctgagcatcatcaacaaaaggaaaaagacatcgttctgtctcatgatgatgttaccagcaacacttgccttccacttgacttcacgcgatggagagccgcgcatgatagtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgtacccaaacctggatgtcggctgaaggagcttggagacaagttgaaaaggtagagacatgggctcttaggcacccaggttttaccatactagctctatttctagcccattacataggcacttccctgacccagaaagtggttatttttatactactaatgctggtcactccatccatgacaatgagatgcgtgggggtaggaaacagagattttgtggaaggtctgtcaggagctacgtgggttgacgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcccacccagggggaagcgactttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaatccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagccacagagattcaaaactcaggaggtacaagcatttttgcggggcacttgaaatgtagacttaagatggacagattggaactcaaggggatgagctatgcaatgtgtttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacatcgaggctgaacctccttttggggaaagcaacatagtgattggaattggagacaaagccttgaaaattaattggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcagatcaacaaccagaatggagaatctattgtggaagcaaatagccaatgagctgaactacatattatgggaaaacaacatcaaattaacggtagttgtgggcgacacaattggggtcttagagcaagggaaaagaacactaacaccacaacccatggagctaaaatattcatggaaaacatggggaaaggcaaaaatagtgacagctgaaacacaaaattcctctttcataatagatggtccaaacacaccggagtgtccaagcgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagttagaaaaagcatcctttatagaggtgaaaacctgtacttggccaaaatcacatactctttggagcaatggtgtactagagagtgacatgatcatcccaaagagtttagctggtcctatctcacaacacaaccacaggcctgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacataccctcataatgattgggtctaacgcttccgacaggatggggatgggcgttacctacttggctttaattgctacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaatacaattttcacgttgactgttgcctggagaacagccaccttgattctggccggagtttcgcttttgccactgtgccagtcttcgagcatgaggaaaacagattggctcccaatgaccgtggcagctatgggagttccacccttaccactttttatcttcagcttgaaggacacacccaaaaggaggagctggccactgaatgagggagtgatggctgttgggcttgtgagcattctggctagttctctcctcaggaatgatgtgcccatggctggaccactagtggccgggggcttgttgatagcgtgctatgtcataactggcacgtcagctgacctcactgtagaaaaagcagcagatgtaacatgggaggaagaggctgagcaaacaggagtgtcccacaatttgatggtcacagttgatgatgatggaacaatgagaataaaggatgatgagactgagaacatcctaacagtgctcttaaaaacagcactactaatagtatcaggcatctttccatactccatacccgccacactgttggtctggcatacttggcaaaagcaaacccaaagatctggcgttctatgggacgtacccagccccccagaaacacagaaagcagaattggaagagggggtctataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccagaattggaagaagaaatgttcaaaaagcgaaatctaaccataatggatcttcatcctgggtcaggaaagacgcggaaatatcttccagccatcgttagagaagcaatcaagagacgcttaagaactctaatcttggcaccaacaagagtggttgcagctgagatggaagaagcactgaaaggactcccaataaggtaccaaacaactgcaacaaaatctgaacacacaggaagggaaattgttgatctaatgtgccacgcaacattcacaatgcgcttgctatcaccagtcagggttccaaattacaatttgataataatggatgaggcccatttcacagatccagccagtatagcggctagagggtatatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccacgctcactggacagaagcaaaaatgctgctagacaacatcaacacaccagaagggatcataccagctctctttggaccagagagggagaagtcagccgctatagacggtgaataccgcctgaagggtgagtccaggaagaccttcgtggaactcatgaggaggggtgacctcccagtttggctagcctataaagtagcctcagaagggatcaaatacacagataggaaatggtgctttgatggagaacgtaacaatcaaattttagaggagaacatggatgtggaaatctggacaaaggaaggagaaaggaaaaaattgagacctaggtggcttgatgcccgcacttattcagatcccttagcactcaaggaatttaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggcaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtctctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccatcataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagccgtttccatggctaacatctttagagggagctacctagctggagctgggcttgctttttctatcatgaaatcagttggaacaggaaggagaggaacggggtcacaaggcgaaaccttaggagaaaagtggaaaaagaaactaaatcagttatcccggaaagagtttgacctttacaagaaatctggaatcactgaagtggacagaacagaagccaaagaagggttgaaaagaggagaaacaacacatcatgccgtgtccagaggcagcgcaaaacttcaatggttcgtggagaggaacatggtcattcccgaaggaagagtcatagacttgggctgtggaagaggaggctggtcatattactgcgcaggactgaaaaaagttacagaagtgcgaggatacacaaaaggcggcccaggacacgaagaaccagtacccatgtctacatacggatggaacatagtcaagctaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgtattaaagtattaaacccctacatgccaactgtgattgagcacctagaaagactacaaagaaaatatggaggaatgcttgtgagaaacccactctcacgaaactccacgcatgaaatgtactggatatccaatggcaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagttaaagccacaggctcagcctcctccatgataaatggagtcgtgaaactcctcacaaagccatgggatgtggttcccatggtgacacagatggcaatgacagatacaactccatttggacagcaaagagttttcaaggagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggaaaaccaatgggataatgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattggcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttttgctcccaccactttcatgagctgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatatctaggaaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagtcagagggagccatttggtaa

SEQ ID NO: 1400 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggttttaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttacaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccataggcctgggtaccacacccaaacggcaggaccttggcacttgggaaaattggagctggactttaactattgtgaaggaacaacagtagtcatcacagaaaactgtgggatgagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccaaagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaaaggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagccggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaaccccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattacgccattataggtccaggattgcaggctaaagccactcgtgaagctcaaaaaagaacagctgctggaataatgaagaatccaacggtagatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaataaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagcggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccaatcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1401 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagccgacgctggacatagagcttcagaagaccgaggccacccaactggcgaccctaaggaagttatgcattgagggaaaaattaccaacataacaactgattcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctaacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggtgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1402 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatgctgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctattccttgcccattacgtaggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgcaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaaggttcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaatactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttctcaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtctaacgcatctgacaggatgggaatgggcgttacctacctagctttaattgcaacatttaaaatccagccattcttggctttgggatttttcctaagaaaactgacatccagagaaaatttattattaggagttgggctggctatggcaacaacgttacaactgccagaggacattgaacaaatggcaaacggaatcgctctggggctcatggctctcaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggattttaagcctggaacttcaggatctcctatcataaacagagagggaaaggtagtgggactgtatggcaatggagtggttacaaagaatggtggctacgtcagcggaatagcgcaaacgaatgcagaaccagatggaccggcaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacagtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggctaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgtctgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacacttctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatactcacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatctttagagggagctatttagcaggagctgggcttgctttttctattatgaaatctgttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccttgttgtgtgacattggagaatcttcaccaagcccaacagtggaggaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgagctccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctgggaaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagataaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 1403 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggggtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1404 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggtaatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctgacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccaggatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatctttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1405 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaagcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacggaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcgtgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctgaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcggccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacactgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccgataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagctaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgttattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtcacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcataagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagcggacaggtaggaacttatggtctgaatacattcaccaacatggaagcccagttaatcagacaaatggaaggagaaggtgtgctgtcaaaggcagacctcgagaaccctcacctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagataaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggagccatttggtaa

SEQ ID NO: 1406 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccttatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgtcacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgccctggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagaatttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactacacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1407 - DNA, 10173 bp, Dengue virus; identical to SEQ ID NO: 1406

SEQ ID NO: 1408 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatataccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagactcaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaaaggaagctctattgggaagatgttcgaggccactgctagaggtgcaaggcgcatggccatcttgggagacacagcttgggactttggatcagtgggtggtgttctgaactcattaggtaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgctgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtcattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggcaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggatatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1409 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctgctttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcatacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacagtggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcggtaggaatcatcacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaactagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagggacatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgtcacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggggaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaacgatgaagaccatgctcactggacagaagcaaaaatgctgctggacaacattaatacaccagaagggatcataccagctctctttgagccagaaagggagaagtcagccgccatagatggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaagaattcaaggactttgcggctggcagaaagtcaatcgcccttgatcttgtgacagaaataggaagagtgccttcacacctagcccatagaacgagaaatgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttctctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaaccataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacgcacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaacggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggttatgcacaagggaagagtttacaaaaaaggtcagaactaacgcagccatgggtgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1410 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgtatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaagcgtggggaaaggcaaaaatagtgacagctgaaacacaaaattcttctttcataatagatggaccaaacacaccggagtgtccaagtgcctcaagagcatggaatgtgtgggaggtggaagattatgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatttggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaactatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatctccatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaacttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaagcaaaagccactcgtgaagctcaaaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactctcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgccaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatatctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1411 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtacaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcatcctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaactcaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctacttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaatgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagatctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1412 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaagaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagtttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggagcaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatgaacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaataccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccactctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttttatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctttttgagccagaaagggagaagtcagccgccatagacggtgagtatcgtctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcacgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacggcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatctgttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1413 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaactaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgagggaaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccaccgctagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaaactagaaaaagcatccctcatagaggtgaaaacctgcacatggccaaaatcacataccctttggagtaatggagtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatttccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaccttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataacaggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctactggacaacatcaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttagacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacagaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccttgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggacgagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1414 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggatccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtaaaaacctgcacatggccaaaatcacataccctttggagtaatggtgtgttagagagcgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacgagggtggttgcagctgagatggaagaagcattaaaagggctcccaataaggtaccaaacaacagcaacaagatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaggatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggataatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtctggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactattgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcaccgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtgcctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgatacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagagtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1415 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagcgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcactaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgaacgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacgagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaacttgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaatatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1416 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggctttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttgtaaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagcgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacgagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttgaacaaaggatggccaatatcaaaaatggacttaggagtacccctgctggcattaggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatgcctcaatggcagccatcaaagggatggcatgattggcagcaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1417 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggtatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtggacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcatcgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagcaatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgtcggaatgggagaagcagccgcaattttcatgacagcaacgccccctggaacagctgatgcctttcctcagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggataaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagcccagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagtcttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccagagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1418 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaatgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcctggataccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaactatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacggttgatgatgatggaacaatgagaataaaagatgatgagactgagaatatcttaacagtgcttttgaaaacagctttactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaataatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttacttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttgaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggattgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgagaatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaactctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1419 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgttcggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtacaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgttagagagtgacatgatcattccaaagagtcttgctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcatcctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctacttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaatgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagatctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1420 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagcggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagatagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgagggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaagactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcatggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaggtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1421 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaaagttggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaattaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaaaaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagaggcgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaccgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactactaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaatatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggatgagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagttcacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacatttaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggagatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1422 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggctttaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggccctcaggcacccagggttcaccatactagccctatttcttgcccattacataggcacttccttgacccagaaggtggttatttttatactgctaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaactatgtgaccataggttaatgtcggcagccgtcaaggatgaaagggccgtacatgccgacatgggctattggatagaaagtcaaaagaatggaagttggaagctagaaaaagcatccctcatagaggtgaaaacctgcacatggccaaaatcacataccctttggagtaatggtgtgttagagagtgacatgatcattccaaaaagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagaaaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctctcaaactgataacacaatttgaaacataccaactatggacagcattaatctccttaacgtgttcaaatacaatttttacgttgactgttgcctggagaacagccaccctgattttggctggagtttcacttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcccggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccttagcactcaaggaattcaaggactttgcggctggcaggaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacactggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttgagacataccatagagaattccacagcaaatgtgtccttggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaggtggatagaacagaagccaaagaagggttgaaaagaggagaaataacacatcatgccgtgtccagaggtagtgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactacgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccataagcggggatgactgcgtagtgaaaccaatcgatgacaggttcgctaatgccctgctcgctctgaacgacatgggaaaggtccggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagagtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1423 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggtcatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcactcgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggaataggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagatagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacacagacaatggttttttgacctacctctaccatggacatcaggagctacaacggaaacaccaacctggaataggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattgggactcaaggggatgagctatgcaatgtgcacgaatacctttgtgttgaagaaagaagtctcggaaacgcagcatgggacaatactcatcaaggtcgagtacaaaggggaagatgtaccttgcaaggttcctttctccacagaggatggacaagggaaagctcacagtggcagactgattacagccaacccagtggtgactaagaaggaggagcctgttaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggaattctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggaactaaaatactcatggaaagcgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattggatccaacgcatctgacaggatgggaatgggcgtcacctacctagctttaattgcaacatttaaaatccagccattcttggctttgggattttttctaagaaaactgacatccagagaaaatttattattaggagttgggctggctatggcaacaacgttacaactgccagaggacattgaacaaatggcaaacggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctactcagatcccctagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtagggcctacaggcatgcggtggaggaactaccagagacaatggaaacacttctactcctaggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacgaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtgtctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgagcgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 1424 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacggaaaaagacatcgctctgtctcatgatgatattgccagcagcacttgctttccacctgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattactgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagccaacgttggatatagagcttcagaagaccgaggccacccaattggcgaccctaaggaagctatgcattgaggggaaaattaccaacataacaactgactcaagatgtcctacccaaggggaagcggctttgcctgaagagcaggaccagaactacgtgtgtaagcatacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcgaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaaggaatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcctgggtatcacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcctttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgccccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacatactatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaaggcccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttatcacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagccatgtatgctgatgacacagccggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcaggcaaatggaaggagaaggtgtgctgtcaaaggcagacctcgagagccatcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatttctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaacgttccatatctaggaaagagagaagaccagtggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1425 - DNA, 10173 bp, Dengue virus; identical to SEQ ID NO: 1424

SEQ ID NO: 1426 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttacggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacgtaggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgcaagcatacatacgtagacagaggctgggggaacggatgtggtttatttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaaggttcctttctccacagaggatggacaagggaaagctcacaatggcagactgatcacagccaacccagtggtgactaagaaggaggagcctgtcaatattgaggctgaacctccttttggggaaagtaatatagtgattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactaaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttctcaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgccttgtgtttggcaatcctctttgaagaggtgatgagaggaaaatttgggaagaaacacatgattgcgggggttttctttacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattattaggagttgggctggctatggcaacaacgttacaactgccagaggacattgaacaaatggcaaacggaatcgctctggggctcatggctctcaaactgataacacaatttgaaacataccagttatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagggagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgtcagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagcaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaaggaatcataccagctctctttgagccagaaagggagaagtcagccgccatagacggtgagtatcgtctgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacacttctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatctttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagtagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggacacttgtggacagagaacgtgagctccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacagatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 1427 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaaaaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1428 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattatataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagaaggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccgtcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccggagaagaaaattacacaatggttggaaaccaaaggagtggagaggttaaaaagaatggccattagtggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctatccatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacctacagcaattcaacaggtgagaagccttataggcaatgaagagtttctggactacatgccttcaatgaagagatttaggaaggaggaggagtcggagggagccatttggtaa

SEQ ID NO: 1429 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgaaaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1430 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgactctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaacttaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagacctggacttcaactattgcgaaggaacaacagttgtcatcacagaaaactgtgggacaagacgcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctgttgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggccggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1431 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggctttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagcgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacccacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacgagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttgaacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagtgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1432 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacatttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttacaaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcttggatggtacataggcaatggttctttgacctacccctaccatggacatcaggaactacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacctgaaatgtagacttaagatggacaaattggaactcaaggggatgagctatgcaatgtgcttgaacacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacagatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagagcattagcaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagtcgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgttataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcataatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaatgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacctgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgatccaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcggtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggattaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaaccccatttgggcagcaaagagttttcaaagagaaagtggacaccaggacacccaggcccatgccagggacaagaaaggttatggagatcacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaactcggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttagaaaccaaaggagtggagagattgaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1433 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctggtaataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtaattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1434 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaggaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcattatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacggaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactgacaccacagcccatggacctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggaaagatatggcacacacattcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttggttctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacctgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctattataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcaccctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagcatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggttatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaactagctatttggatgtagacttgcacccagcatcagcctggacactgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagatttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccttattgtgtgacattggagaatcttcaccaagcccaacagtggaagaaagcagaactataagagtcttgaagatggttgagccatggctgaaaaacaaccagttttgtattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaggccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattaggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagcggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcacgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccataagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatctggtaa

SEQ ID NO: 1435 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaacttaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagacctggacttcaactattgcgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggcgcttaaactgataacacaatttgaaacataccaattatggacagcattaatctccttaacgtgttcaaatacaatgtttacgttgactgttgcctggagaacagccaccctgattttggccggagtttcgcttttaccagtgtgtcagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcacacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagattacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagttaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatttagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1436 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgactctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaacttaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagacctggacttcaactattgcgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctgttgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggccggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagtccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1437 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggataaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcctgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacacatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagccatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1438 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacacatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagccatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1439 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtataaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacttagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatctttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaaggtatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagagaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacagggccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtaaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaacgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggagaagatcacacagcaaatggaccctgaacacaggcagctagctaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1440 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgactctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgttcttggatcgcaagagggagcaatgcataccgcattgacaggagccacagaaatccaaaactcaggaggcacaagtatttttgcggggcacttaaaatgtagacttaagatggacaaattggaacttaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagacctggacttcaactattgcgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagtcccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacacgaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctgttgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggccggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggtaatgaagagtttctggactacatgccttcaatgaagagatttaggaaggaggaggagtcggagggagccatttggtaa

SEQ ID NO: 1441 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgtatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaagcgtggggaaaggcaaaaatagtgacagctgaaacacaaaattcttctttcataatagatggaccaaacacaccggagtgtccaagtgcctcaagagcatggaatgtgtgggaggtggaagattatgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatttggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaactatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatctccatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaacttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaagcaaaagccactcgtgaagctcaaaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgccaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatatctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1442 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggtacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggagttggagacaacgccttgaaaatcaactggtacaagaagggaagctctattgggaagatgtttgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaagaagaagttggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaattggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcagttgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataatttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgttatatatgattcaaaatttgaaaagcaactgggacaggttatgctcctggttttgtgtgcagttcaacttttgttaatgagaacatcatgggccttgtgtgaggctttaactctagctacaggaccaataacaacactctgggaaggatcacctgggaagttttggaacaccacgatagctgtttccatggcaaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattgagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagtcatttggtaa

SEQ ID NO: 1443 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcaggggccattaagatcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtaggaaatgaaacgcagggagtcacggctgagataacacctcaggcatcaaccactgaagccatcttacctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacttggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggagttggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatgggatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttgccagtgtgccagtcttcgagcatgaggaaatcagactggcttccaatgacagtggcagctatgggagttccacctctaccactttttatttttagcttgaaggacacactcaaaagaagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtgcagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactatatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactagactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcttggttttgtgtgcagttcaacttctgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagttcacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcggacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1444 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgtttatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggtcatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagactgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgttgacagaggctgggggaacggatgtggtttgtttggcaagggaagcttggtaacatgtgcgaaatttcaatgcctggaaccaatagagggaaaagtggtgcaatatgagaaccttaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaacacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagagcaatacaaattccaagcagactccccgaaaagattggcgacagccattgcaggcgcctgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcgtggaaaacgtggggaaaggcaaaaatagtgacagctgaaacacaaaattcttctttcataatagatggaccaaacacaccggagtgtccaaatgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccgcctctaccactttttatttttagcttgaaagacacactcaaaaggagaagctggccattgaatgaaggggtgatggctgttgggcttgtgagcattctggccagttctctccttagaaatgatgtacccatggctggaccattagtggccgggggcttgctgatagcgtgctacgtcataactggcacatcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttggcatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaaggactcccaataaggtaccaaacaacagcaacaaaatctgaacacacaggaagagagattgttgatctgatgtgccatgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggagaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagatggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaacaatcaaattttagaagagaacatggatgtggaaatctggacaaaggaaggagaaaggaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgcactggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaatcgcttccagcggcatgttgtggatggccgaaatcccactccaatggattgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagcgagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattacgctattattggtccaggattgcaggcaaaagccactcgtgaagctcagaaaaggacagctgctggaataatgaagaatccaacggtggatgggataatgacaatagacctagatcccgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcaccgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaggtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcactaacatggaagtccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcatcaggtgagaagccttataggcaatgaagagtttctggactacatgccttcaatgaagagatttaggaaggaagaggagttggagggagccatttggtaa

SEQ ID NO: 1445 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaaaaccgaggccacccaactggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacagtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatctctcatagaggtgaaaacctgcacatggccaaaatcacatactctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttatcttcacgtttgtactccttctctcagggcaaataacatggagagatgtggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttaggaatgatgtgcccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagacctgatttcatacggaggaggatggagattgagcgcacaatggcaaaagggggaggaggtgcaggttattgccgtagagcctgggaaaaatccaaagaactttcaaaccatgccaggcatttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgcagcgcaaaggagagggagagttggcaggaacccacaaaaagaaaatgaccagtacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatatgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaactagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagagggggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactgtaagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcatatttcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttctggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagctttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1446 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggtcatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaaggttcctttctccacagaggatggacaagggaaagctcacagtggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggaactaaaatactcatggaaaacgtggggaaaggcaaaaatagtgacagctgaaacacaaaattcttccttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattggatccaacgcatctgacaggatgggaatgggcgtcacctacctagctttaattgcaacatttaaaatccagccattcttggctttgggattttttctaagaaaactgacatccagagaaaatttattattaggagttgggctggctatggcaacaacgttacaactgccagaggacattgaacaaatggcaaacggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtagggcctacaggcatgcggtggaggaactaccagagacaatggaaacacttctactcctaggactcatgatcttgttgacaggtggagcaatgctattcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgagcgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 1447 - DNA, 10176 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccatggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacatgtcactcaaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1448 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgctttgaaaatcaactggtacaagaagggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtttgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccgtcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgatagcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattgatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactctttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcacaagcaaacccaaagatccggcgttccatgggatgtacccagccctccagagacacagaaagcagaactggaagaaggggtctataggatcaaacagcaaggaatttttgggaaaacccaagtaggggttggagtacagaaagaaggagtcttccactccatgtggcacgttacaagaggggcagtgttgacatataatgggaaaagactggaaccaaactgggctagcgtgaagaaagatctgatttcatacggaggaggatggagattgagcgcacaatggcaaaagggggaggaggtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggattatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccggagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattaatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1449 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcctacgttggatatagaacttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccacttcaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1450 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgtctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagctaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtgattacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgacctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtacgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaggcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1451 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagtataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagaaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1452 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttccttagatttctagccattccaccaacagcaggagttttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgcacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaaaaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcatacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaacgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatctttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctcttttataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcattacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacttatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttacaggatcaaacaacaaggaatttttggaaaaacccaagtgggggttggagtgcagaaagaaggagtcttccacaccatgtggcacgtcacaagaggggcagtattgacgcacaatgggaaaagactggaaccaaactgggccagtgtgaaaaaagatctgatttcatacggaggaggatggagattgagtgcacaatggcaaaaaggagaggaggtgcaggttattgctgtggagcctgggaagaacccaaaaaacttccaaaccatgccgggcatttttcagacaacaacgggggaaataggagcaattgcactagacttcaagcctggaacttcaggatctcctatcataaacagagagggaaagatagtgggactgtatggcaatggagtggttacgaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccatcgtcagagaagcaatcaagagacgtttgagaactctaattttggcaccaacaagagtggttgcagctgagatggaagaagcactgaaaggactcccaataaggtatcaaacaactgcaataaaatctgaacacacaggaagggagattgttgatctaatgtgccacgcaacattcacaatgcgcttgctatcaccagtcagggttccaaattacaatttgataataatggatgaggcccacttcacagatccagccagtatagcggctagagggtacatatcaactcgtgtaggaatgggagaggcagctgcaatcttcatgacagcaacaccccctggaactgctgaagcctttcctcagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagctaactttaaagcagatagagtgattgacccaagacgatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcgaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaactgtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctattatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaatatagtcaaactaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcaagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaacccccatctactagagaagaaaatcacacaatggttggaaaccaaaggagtggagagattaaaaagaatggccatcagcggagatgattgcgtggtaaaaccgattgatgacaggtttgccaatgccctgcttgctctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1453 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaggaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcattatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacggaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagactacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctattaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacattcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccactttggttctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacctgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctattataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcaccctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagcatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggttatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaactagctatttagatgtagacttgcacccagcatcagcctggacactgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgcaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagatttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccttattgtgtgacattggagaatcttcaccaagcccaacagtggaagaaagcagaactataagagtcttgaagatggttgagccatggctgaaaaacaaccagttttgtattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaggccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccaggaacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattaggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcacgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccataagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatctggtaa

SEQ ID NO: 1454 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcctggctagatggggaaccttcaagaagtcaggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctagtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccgactggcgaccctaaggaagttatgcattgagggaaaaattaccaacataacaactgactcaaggtgtcccacccagggggaagcgattctacctgaggagcaggaccagaactacgtatgtaagcacacatacgtggatagaggttggggaaacggttgtggcttgtttggaaaaggaagcttggtgacatgcgcgaaatttcaatgtctagaactaatagagggaaaagtggtgcaatatgagaaccttaaatacactgtcatcatcacagtgcacacaggagaccaacaccaagtgggaaatgacacgcagggagccacggttgagataacaccccaggcatcaaccgttgaagccgtcttgcctgagtatggaacccttgggctagaatgctcgccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtgacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgcgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaattaacggtagttgtgggtgacataattggggtcttagagcaagggaaaagaacgctaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggctgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaaggggcccatcattgagaacaacaacagtgtcagggaagctgatacacgaatggtgttgccgctcgtgcacacttcctcccttacgatacatgggagaggacggctgctggtatggtatggaaattagacctatcaatgagaaagaagagaacatggtaaagtctttagtctcagcagggagtggaaaggtggacaacttcacaatgggagccctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacagaatgggaatgggcgttacctacttagctttaattgcaacattcaaaatccagccattcttggctttgggattcttcctgaggaaattgacatccagagaaaatttgctgttgggagttgggttggccatggcaacaacgttacaactgccagaggacattgaacagatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatggctgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggtagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatctttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacatttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcttacagaacgagaaacgccctggacaacttggtgatgttgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttactgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtcttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtttacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtccaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaaggaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagtcttataggcgatgaagaatttctggactacatgccttcgatgaagagattcaggaaggaggaggagtcagagggagccatttggtaa

SEQ ID NO: 1455 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggaatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcctctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccaggttgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1456 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctactcagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcatacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgtatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagaatgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaatgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagtgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccaacaccggaattggaagaagaaatgttcaaaaagcgaaatttaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatggaaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaagagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgcgtggtgaaaccgattgatgacaggttcgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1457 - DNA, 10173 bp, Dengue virus; identical to SEQ ID NO: 1438

SEQ ID NO: 1458 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcatttatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagtcttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaagggtcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1459 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaacctttaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccggataccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaagatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacggtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagtccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacgggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1460 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtagaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcttcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttattgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaagatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattggtcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1461 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaaatcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggggaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtgcccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1462 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatggttgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacgatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1463 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaacttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaggatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1464 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccactacataggcacttccttgacccagaaggtggttatttttatactactaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaataaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtttagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatggttgcgggggttttcttcacgtttgtactccttctctcagggcaaataacatggagagatatggcgcacacactaataatggttgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgtcagtcttcgagcatgaggaaaacagactggcttccaatgacggtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatccttacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagagctggaagaaggggtctataggatcaaacagcaaggaatttttgggaaaacccaagtgggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgttcccagcattaaagccggaaatgacatagcaaactgcttgcgaaaaaacgggaaaaaggtcattcaacttagtaggaagacttttgatacagaatatcagaaaactaaactgaatgattgggacttcgtggtgacgactgacatttcagaaatgggggccaatttcaaagcagatagagtgatcgaccctagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccctcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatagccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttctgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacggaactccacgcacgaaatgtactggatatctaatggcacaggtaacattgtcgcttcagtcaacatggtatctagactgctactgaacaggttcacgatgacatacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaagtgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1465 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgtttatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgtccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggtcatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgttgacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacggtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcctacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaaatgcctcaagagcatggaatgtgtgggaggtggaagattacgggttcggagtcttcacaaccaacatatggctgaaactccgagaggtgcatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctttttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccgcctctaccactttttatttttagcttgaaagacacactcaaaaggagaagctggccattgaatgaaggggtgatggctgttgggcttgtgagcattctggccagttctctccttagaaatgatgtacccatggctggaccattagtggccgggggcttgctgatagcgtgctacgtcataactggcacatcagcagacctcaccgtagaaaaagcagcagatgtaacatgggaggaagaggctgagcaaacaggagtgtcccataacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttggcatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccataccaggcacttttcagactacaacaggggaaataggagcaattgcactggatttcaagcctggaacctcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaacaatcaaattttagaagagaacatggacgtggaaatttggacaaaggaaggagaaaggaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattacgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaggtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcactaacatggaagtccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcatcaggtgagaagccttataggcaatgaagagtttctggactacatgccttcaatgaagagatttaggaaggaagaggagttggagggagccatttggtaa

SEQ ID NO: 1466 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacgatcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccacaggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttagggaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccgtcagtgagaaagaagagaacatggtaaagtctttagtctcagcgggaagtggagaggtggataacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgctcaaatacaattttcacgttgactgttgcctggagaacagccaccctgattttggccggagtttcgcttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacctgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggatcagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcattggacggaagcaaaaatgctgctggacaacattaacacaccagaagggatcataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcttggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctggatcctgtaatatatgattcaaaatttgaaaagcaactgggacaggttatgctcctggttttgtgtgcagttcagcttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacggggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacctatgtccacatatgggtggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccctacatgccaactgtgattgagcacctagaaagactacaaaggaaacatggaggaatgcttgtgagaaatccactttcacgaaactccacgcacgaaatgtactggatatccaatggcacaggtaatattgtcgcttcagtcaacatggtatctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggataccagaacacccaggcccatgccaggaacaagaagggttatggggatcacagcggagtggctctggagaaccctgggaaggaataaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagcggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagagaccgcatgtctggggaaagcctacgctcaaatgtggagtctcatgtactttcacagaagagacctcagactagcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1467 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtgggtaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtggagacatgggcccttaggcacccagggttcaccatactagccctatttcttgcccattacataggcacatccttgacccagaaggtggttatttttatactactaatgctggtcaccccatccatgacgatgagatgtgtgggaataggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggctttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaacatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaactcttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcacaccgcattgacaggagccacagaaatccaaaactcaggaggcacaagtatttttgcggggcacttaaaatgcaggcttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaagttccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgccgcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggattgaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggatgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctcagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttattttttgcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaaggtccggcgttctatgggacgtacccagccccccagagacacagaaagcagaactggaagaaggggtctataggatcaaacagcaaggaatttttgggaaaacccaagtgggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatctcagaaatgggggccaacttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacataaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgctatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgctggaaactacaaagagagatttaggaatgtctaaggagccaggtgttgtctctccaactagctatttagatgtggacttgcacccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacctaggagtacccctactggcattgggttgctattcacaagtgaacccactaactctaacagcggcagtactcttgctgatcacacattatgctattataggtccaggattgcaagcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttctgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttatcatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttaggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaatcacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagcctcaaagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaggacatgcttactgtctggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacctacagcaattcaacaggtgagaagccttataggcaatgaagagtttctggactacatgccttcaatgaagagatttaggaaggaggaggagtcggagggagccatttggtaa

SEQ ID NO: 1468 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgtatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacccctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagactcaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgtattgcgataggaatcattacactctatctgggagctgtggtgcaagctgacacggggtgtgttataaactggaaaggaaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaagtgaaaacctgcacatggccaaaatcacataccctttggagtaatggtgtgttagagagtgacatgatcattccaaagagtctagctggtcctatctcgcaacacaactataggcccgggtaccacacccagacggcgggaccctggcatttaggaaaattagagctggacttcaactattgtgaagggacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggcgttttcttcacgtttgtactccttctctcagggcaaataacatggagagatatggcgcacacactaataatgattgggtccaacgcatctgacaggatgggaatgggcgttacctacctagctttaattgcaacatttaaaatccaaccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgacgtacccatggctggaccattagtggccgggggcttgctgatagcgtgctacgtcataactggcacgtcagcagacctcgccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcactttccagactacaacaggggaaataggagcaattgcactggatttcaagcctggaacttcaggatctcctatcataaatagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacattttcagagggagctatttagcaggagctgggcttgctttttctattatgaaatcagttggaacaggaaaaagaggaacaggctcacagggtgaaactttaggagaaaaatggaagaagaagttaaatcaattatcccggaaagagtttgacctttacaagaaatctggaatcactgaagtggatagaacagaagccaaagaagggttgaaaagaggagaaataacacatcacgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacggaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccacggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaacgcagccatgggagccgttttcacagaggagaaccaatgggacagcgcaaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaactctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggtcccctgcagaccccaggacgaactaataggaagagcaagaatctctcaaggagcgggatggagccttagagaaaccgcatgtctggggaaagcctacgctcaaatgtggagtctcatgtattttcacagaagagatctcagactagcatctaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1469 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggtatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggagctcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcgaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattctcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacagattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaagcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatcccttatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagacaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacttttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgatcttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacccagccctccagagacacagaaggcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatttcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagtattaaagccggaaatgacatagcaaactgcttgcggaaaaacgggaaaaaggtcattcaacttagcaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggaacataattcaacatggcactatgatgacgaaaacccctacaaaacctgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacatcaaatggaccctgaacacaggcagctagcgaacgctatatttaagctcacataccaaaataaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1470 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatggtattgccagcagcacttgctttccatttgacttcacgagatggagagccgcgcatgattgtggggaagaatgaaagaggaaaatccctactttttaagacagcctctggaattaacatgtgcacactcatagccatggacttgggagagatgtgtgatgacacggtcacttataaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggattagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaattccaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagactcaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatctctcatagaggtgaaaacctgcacatggccaaaatcacataccctttggagtaacggtgtgctagagagtgacatgatcatcccaaagagtctagctggtcctatttcgcaacacaaccacaggcccgggtaccaaacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagagatgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggtgttacctacctagctttaattgcagcatttaaaatccagccattcttggctttgggatttttcctaagaaaactgacatccagagaaaatttattgttaggagttggactggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcgcaatggcaaaagggggaggaggtgcaggttattgccgtagagcctgggaagaacccaaagaactttcaaaccatgccaggcactttccagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttccccagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgttggacaacattaacacaccagaagggatcataccagctctctttgagccagaaagggagaagtccgccgccatagacggtgagtaccgcttgaaaggtgagtctaggaagactttcgtggaactcatgaggaggggtgaccttccagtctggttagcccataaagtagcatcagaagggatcaaatacacagatagaaaatggtgctttgatggacaacgtaataatcaaattttagaggagaacatggatgtggaaatctggacaaaggaaggagaaaagaaaaaattgagacccaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggtggtagggcttacaggcatgcggtggaggaactaccagagacaatggaaacacttctactcttgggactcatgatcttgttgacaggtggagcaatgcttttcttaatatcaggtaaagggattggaaagacctcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatactcacattggctgcaataatagcagccaatgaaatgggattgttggaaactacaaagagagatttaggaatgtctaaggagccaggtgtcgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtactgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggcaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttatcatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggccatggggatcacagcggagtggctctggagaaccttgggaaggaacaaaaaacccaggttatgcacaagggaagagtttacaaaaaaggtcagaactaacgcagccatgggcgccgttttcacagaggagaaccaatgggatagcgcgaaagctgctgttgaggatgagaatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaagattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1471 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgattacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccgaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagtcagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1472 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1473 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacggaaaaagacatcgctctgtctcatgatgatattgccagcagcacttgctttccacctgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattactgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagccaacgttggatatagagcttcagaagaccgaggccacccaattggcgaccctaaggaagctatgcattgaggggaaaattaccaacataacaactgactcaagatgtcctacccaaggggaagcggctttgcctgaagagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcgaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggataaattggaactcaaaggaatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcctgggtatcacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcctttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacatatcaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgccccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaaggcccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttatcacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttataacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcaggcaaatggaaggagaaggtgtgctgtcaaaggcagacctcgagagccatcatctgccagagaagaagattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatttctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaacgttccatatctaggaaagagagaagaccagtggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1474 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacggaaaaagacatcgctctgtctcatgatgatattgccagcagcacttgctttccacctgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattactgaagtggaacctgaagacattgactgctggtgcaaccttacatcaacatgggtgacttatggaacgtgcaatcaagctggagagcatagacgcgacaagagatcagtggcgttagctccccatgtcggcatgggactagacacacgcacccaaacttggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagccaacgttggatatagagcttcagaagaccgaggccacccaattggcgaccctaaggaagctatgcattgaggggaaaattaccaacataacaactgactcaagatgtcctacccaaggggaagcggctttgcctgaagagcaggaccagaactacgtgtgtaagcatacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcgaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaaggaatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagccgacatggggtgtgttataaactggaaaggcaaagaactcaaatgtggaagtggaatcttcgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcctgggtatcacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcctttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgacgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaagcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgccccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttaacacagaatatcagaaaactaaactgaatgattgggacttcgtggtgacaactgacatttcagaaatgggggccaatttcaaagctgatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacatactatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtgcctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaaggcccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttatcacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcaggcaaatggaaggagaaggtgtgctgtcaaaggcagacctcgagagccatcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatttctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaacgttccatatctaggaaagagagaagaccagtggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1475 - DNA, 10173 bp, Dengue virus
atgaacaaccaacggaagaagacgggaaaaccgtctatcaatatgctgaaacgcgcgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcctggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaggaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggcgctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgctatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1476 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacgtaggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatttgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagttcctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1477 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggtcatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacacagacaatggttttttgacctacctctaccatggacatcaggagctacaacggaaacaccaacctggaataggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcggaaacgcagcatgggacaatactcatcaaggtcgagtacaaaggggaagatgtaccttgcaaggttcctttctccacagaggatggacaagggaaagctcacagtggcagactgattacagccaacccagtggtgactaagaaggaggagcctgttaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggaattctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatattaaattaacggtagttgtgggcgacataattggggtcttagagcaaggaaaaagaacactaacaccacaacccatggaactaaaatactcatggaaagcgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattggatccaacgcatctgacaggatgggaatgggcgtcacctacctagctttaattgcaacatttaaaatccagccattcttggctttgggattttttctaagaaaactgacatccagagaaaatttattattaggagttgggctggctatggcaacaacgttacaactgccagaggacattgaacaaatggcaaacggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctactcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtagggcctacaggcatgcggtggaggaactaccagagacaatggaaacacttctactcctaggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaattactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgagcgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 1478 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagatatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgtcaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1479 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcactcaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagcaacatagtaattggaactggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttaacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaagactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccattagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtatttttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggccatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgctaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaacttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccacaaagtagcatcagaagggatcaaatatacagatagaaaatggtgctttgatggacaacgtaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatagccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattaggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaggaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacctggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1480 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtatcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaaccaagccggagagcacagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcctgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaataatatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1481 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgtcataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaatgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1482 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaacgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcggacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1483 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttatttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggagctcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcgaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattctcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaagcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagacaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacttttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatttcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagtattaaagccggaaatgacatagcaaactgcttgcggaagaacgggaaaaaggtcattcaacttagcaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagcgccgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcacacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggaacataattcaacatggcactatgatgacgaaaacccctacaaaacctgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacatcaaatggaccctgaacacaggcagctagcgaacgctatatttaagctcacataccaaaataaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1484 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaagggaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactctcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggtcagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaacgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1485 - DNA, 10173 bp, Dengue virus
atgaacaaccaacggaagaaggcgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcattagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtgcatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacaaccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaacggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaacggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctatgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccggaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcatgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgaatctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaacaatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1486 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggtacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggagttggagacaacgccttgaaaatcaactggtacaagaagggaagctctattgggaagatgtttgaggccactgccagaggtgcaaggcgcatggccatcttgggagacacagcttgggactttggatcagtgggtggtgttctgaactcattaggtaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaaatgtggaagtggaatcttcgtcaccaacgaggtccatacctggacagagcagtacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaagaagaagttggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgctcttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcagttgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataatttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagcagccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactactactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgttatatatgattcaaaatttgaaaagcaactgggacaggttatgctcctggttttgtgtgcagttcaacttttgttaatgagaacatcatgggccttgtgtgaggctttaactctagctacaggaccaataacaacactctgggaaggatcacctgggaagttttggaacaccacgatagctgtttccatggcaaacatttttagagggagctatttagcaggagctgggcttgctttttctatcatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagcggagtggaaggagaaggactgcacaagctaggctatatattgagggacatttctaagatacccggaggagctatgtatgctgatgacacagctggttgggacacaagaataacagaagatgacctgcacaatgaggaaaaaatcacacagcaaatggaccctgaacacaggcagctagcgaacgccatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaatcacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcccttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacttgggcccagaacatacccacagcaattcaacaggtgagaagccttataggcaatgaagagtttctggactacatgccttcaatgaagagatttaggaaggaggaggagtcggagggagtcatttggtaa

SEQ ID NO: 1487 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaacgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 1488 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataattaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttggctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggattttaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaaaaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgtcgcctggagaacagccaccctgattttggccggagtttcgcttttaccagtgtgccagtcttcgagcatgaggaaatcagactggcttccaatgacagtggcagctatgggagttccaccgttaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacactgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgtcacaagaggggcagtgttaacatataatgggaaaagactggaaccaaactgggctagcgtgaaaaaagatctgatttcatacggaggaggatggagattgagcgcgcaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccggttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccaaagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgcccactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggatttgcacccagcatcagcctggacattgtatgctgtggccaccacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggcacacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtttctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgcgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagcctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagttacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaaaagatttaggaaggaggaggagtcggagggagccatttggtaa

SEQ ID NO: 1489 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggtgcttgggagaatggagtgtgtggaattaggtcaacgaccagaatggagaatctcctgtggaagcaaatagccaatgaactgaactacatattgtgggaaaacaatatcaaattaacggtagttgtgggcgatataattgggatcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaattacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgattttaccagtgtgccagtcttcgagcatgaggaaatcagactggcttccaatgacagtggcagctatgggagttccacctctaccactttttatttttagcttgaaagacacactcaaaagaagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagtcagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttagaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagctactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcccaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1490 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggcgtatacccaactatgtgaccataggctaatgtcggcagccgtcaaggatgagagggccgtacatgctgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggttcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1491 - DNA, 10173 bp, Dengue virus; identical to SEQ ID NO: 1429

SEQ ID NO: 1492 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttccttagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacaccccaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaattgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagtagtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacagaatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgactgtggcagctatgggagttccacctctaccactttttatttttagcttgaaagacacactcaaaaggagaagctggccactgaatgaaggggtgatggctgttgggcttgtgagcatcctggccagttctctccttagaaatgatgtacccatggcaggaccattagtggccgggggcttgctgatagcgtgctacgtcataactggcacctcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggagtctataggatcaaacagcaaggaatttttgggaaaacccaagtaggggttggagtacagaaagaaggagtctttcacaccatgtggcacgtcacaagaggggcagtgttgacatataatgggaaaagactggaaccaaactgggctagcgtgaaaaaagatctgatctcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaggagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaagatggatttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagcagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgccatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccgtggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 1493 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaggagggccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1494 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggctcatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttctcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1495 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagatattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctatgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagagatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggccatgggagctgttttcacagaggagaaccaatgggatagcgcgagagctgctgttgaggacgaagaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1496 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacatggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatctctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatctgcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttattgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaagatgtgttttatcttccacctgaaaagtgtgacaccctgttgtgtgacattggagaatcttcaccaagcccaacagtggaagaaagcagaaccataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgccatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacagattcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1497 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcttcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagagagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataatatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttattgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaagatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1498 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcagtgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagcatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggatatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1499 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttccttagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacaccccaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacgagggaaagctcacaatggcagactgattacagccaacccagtggtgactaagaaggaggagcctgtcaatattgaagctgaacctccttttggggaaagtaatatagtaattggaattggagacaatgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaattgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagtagtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgactgtggcagctatgggagttccacctctaccactttttatttttagcttgaaagacacactcaaaaggagaagctggccactgaatgaaggggtgatggctgttgggcttgtgagcatcctggccagttctctccttagaaatgatgtacccatggcaggaccattagtggccgggggcttgctgatagcgtgctacgtcataactggcacctcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttctgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgtcacaagaggggcagtgttgacatataatgggaaaagactggaaccaaactgggctagcgtgaaaaaagatctgatctcatacggaggaggatggagattgagcgcacaatggcaaaagggggaggaggtgcaggttattgccgtagagcctgggaagaacccaaagaactttcaaaccatgccaggcacctttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaggagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgcccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaagatggatttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactccaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagcagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgccatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccgtggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1500 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagttttggctagatggggaaccttcaagaagtcgggggccattaaggtcctgaaaggcttcaagaaggagatctcaaacatgctgagcataatcaacaaacggaaaaagacatcgctctgtctcatgatggtattgccagcagcacttgctttccatttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggattagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaattccaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagactcaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatctctcatagaggtgaaaacctgcacatggccaaaatcacataccctttggagtaacggtgtgctagagagtgacatgatcatcccaaagagtctagctggtcctatttcgcaacacaaccacaggcctgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggtgttacctacctagctttaattgcaacatttaaaatccagccattcttggctttgggatttttcctaagaaaactgacatccagagaaaatttattgttaggagttggactggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcgcaatggcaaaagggggaggaggtgcaggttattgccgtagagcctgggaagaacccaaagaactttcaaaccatgccaggcactttccagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttccccagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgttggacaacattaatacaccagaagggatcataccagctctctttgagccagaaagggagaagtccgccgccatagacggtgagtaccgcttgaaaggtgagtctaggaagactttcgtggaactcatgaggaggggtgaccttccagtctggttagcccataaagtagcatcagaagggatcaaatacacagatagaaaatggtgctttgatggacaacgtaataatcaaattttagaggagaacatggatgtggaaatctggacaaaggaaggagaaaagaaaaaattgagacccaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggtggtagggcttacaggcatgcggtggaggaactaccagagacaatggaaacacttctactcttgggactcatgatcttgttgacaggtggagcaatgcttttcttaatatcaggtaaagggattggaaagacctcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatactcacattggctgcaataatagcagccaatgaaatgggattgttggaaactacaaagagagatttaggaatgtctaaggagccaggtgtcgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggcaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccaccagagagtctttaaagagaaagtggacaccaggacacccaggtccatgccaggaccaagaagggccatggggatcacagcggagtggctctggagaaccttgggaaggaacaaaaaacccaggttatgcacaagggaagagtttacaaaaaagggcagaactaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgccacagctggttgggacacaagaataacagaagatgacctgcacaatgaggaaaagatcacacagcaaatggaccctgaccacaggcagttagcgaccgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1501 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcgacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttggcccataaagtagcatcagaagggatcaaatatacagatagaaaatggtgctttgatggacaacgtaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1502 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcgtggaggcaagtcgagaaggtagagacatgggcccttaggcacccagggttcaccatactagccctatttcttgcccattacataggcacttccttgacccagaaggtggttatatttatactactaatgctggtcaccccatccatgacaatgagatgtgtgggagtgggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggcgtatacccaactatgtgaccataggctaatgtcggcagccgtcaaggatgagagggccgtacatgccgacatgggctattggatagaaagccaaaagaaaggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacaacaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaactcagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaacgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcaaagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacagattcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagttcctggactacatgccttcaatgaagagatttaggaaggaggaggagtcggagggagccatttggtaa

SEQ ID NO: 1503 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggtttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaactcttgggctagaatgctcaccacggacaggtttggacttcaatgaaatgatcttgttaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcacaccgcattgacaggagccacagaaatccaaaactcaggaggcacaagcatttttgcggggcacttaaaatgtagacttaagatggacaaattagaactcaagggaatgagctatgcaatgtgcacgaacacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaagtggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaggcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgctaggagttgggctggctatggcaacaacgttacaactgccagaggacattgaacaaatggcaaatggaatcgctctggggctcatggctctcaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttattttcagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacaaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgacctaatgtgccacgcaacgttcacaatgcgtctgctgtcaccagttagggttccaaattataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaggaaagggacataccagaacgctcatggaattcaggcaatgaatggataaccgacttcgctgggaaaacggtgtggtttgttcccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcacagcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacttagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccataatcctggagttttttatgatggtgttgcttataccagaaccagaaaagcagagaaccccccaagacaaccaactcgcatatgtcgtgataggcatacttacattggcggcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatctcctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaagcttcaatggtttgtggagagaaacatggtcattcccgaaggaagagttatagacttgggctgtggaagaggaggttggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagagacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccatcagcggggatgattgcgtagtgaaaccaatcgatgacaggttcgctaatgccctgctcgccctgaacgatatgggaaaggttcggaaggacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctgggaaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1504 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccagacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatgtcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtgacatgggaggaagaggctgagcaaacaggagtgtcccacaacttaatgatcacagttgatgatgatggaacaatgagaataaaagatgatgagactgagaatatcttaacagtgcttttgaaaacagcattactaatagtgtcaggaatctttccatactccatacccgcaacattgttggtctggcatacttggcaaaagcaaacccaaagatccggcgttctatgggatgtacctagccctccagagacacagaaagcagaactggaagaaggggtctacaggatcaaacagcaaggaatttttgggaaaacccaagtaggggttggagtacagaaagaaggagtctttcacaccatgtggcacgttacaagaggggcagtgctgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagctgccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcgaaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttctagcggcatgttgtggatggctgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacctctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccctgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaagtcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacgtagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1505 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacgtaggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccactatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgcaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaaggttcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttctcaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattattaggagttgggctggctatggcaacaacgttacaactgccagaggacattgaacaaatggcaaacggaatcgctctggggctcatggctctcaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgtctgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacacttctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatccagtgatatatgattcaaaatttgaaaagcaactgggacaggttatgctcctggttttgtgtgcagttcaacttttattaatgagaacatcatgggccttgtgtgaagctttaactctagccacaggaccaataacaacactctgggaaggatcacctgggaagttttggaacaccacgatagctgtttccatggcgaacatctttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagtcttgaagatggttgaaccatggctaaagaacaaccaattttgtattaaagtattgaacccttacatgccaactgtgattgagcacctagaaagattacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgagctccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 1506 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaagggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacaccccaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtattttttcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcaccccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattgatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagtttcacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacacgggaggaagaggctgagcaaacaggagtgtcccacaacttaatgaccacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacgccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggactaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgtcgtggatggccgaaatcccactccaatggatcgcgtcggctatagtcctggagttttttatgatggtgttgcttataccagaaccagaaaagcagagaaccccccaagacaaccaacttgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtgcccctactggcattgggctgctattcacaagtgaacccactgactctaacagcggcagtactcttgctgatcacacattatgctatcataggtccaggattgcaggcaaaagccactcgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagttgggcttgctttttctattatgaaatcagttggaacaggaaaaagaggaacaggctcacaaggtgaaactttaggagaaaaatggaaaaagaaattaaatcaattatcccggaaagagtttgatctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggtttgctaatgccctgctcgctctgaacgatacgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1507 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcatttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctyattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaagggatgagctatgcaatgtgcttgggtagctttgtgttgaagaaagaagtctccgaaacgcagcatgggacaatactcattaaggttgagtacaaagggaaagatgcaccctgcaagattcctttctccacggaggatggacaaggaaaagctcacaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggctactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaagagactggcaacagccattgcaggcgcttgggaaaatggagtgtgcggaattaggtcaacaaccagaatggagaacctcttgtggaagcaaatagccaatgaactgaattacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaggattacgggttcggagttttcacaaccaacatatggctgaaactccgagaggtgtacacccaactatgtgaccataggctaatgtcggcagccgtcaaggatgagagggctgtacatgccgacatgggctattggatagaaagccaaaagaatgggagttggaagctagaaaaagcatccttcatagaggtgaaaacctgcacatggccaaaatcacacactctctggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacggtgtcagggaagttgatacacgaatggtgctgccgctcgtgcacacttcctcccctacgatacatgggagaagacggctgctggtatggcatggaaatcagacccattaatgagaaagaagagaatatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccactcctggctttgggattcttcctgaggaaactgacatctagagaaaatttattgctgggagttgggttggccatggcagcaacgttacgactgccagaggacattgaacagatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagctcaacccctaccactttttattttcagtctgaaagatacactcaaaaggagaagctggccactgaatgagggggtgatggcagttggacttgtgagcattctagctagttctctccttaggaatgatgtgcctatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatggtcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcatgtcacaagaggggcagtgttgacacacaatgggaaaagactggaaccaaactgggctagcgtgaaaaaagatctgatttcatacggaggaggatggagattgagtgcacaatggaaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatctccatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggttattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaagaattcaaggattttgcagctggcagaaagtcaatcgcccttgatcttgtgacagaaataggaagagtgccttcacacttagcccacagaacgagaaacgccctggataatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcatcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtctctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccacccgtgaagctcagaaaaggacagctgctggaataatgaagaatccaacggtggatggaataatgacaatagacctagatcctgtaatatatgattcaaaatttgaaaagcaactaggacaggtcatgctcctggttctgtgtgcagtccaacttttattgatgagaacatcatgggccttgtgtgaagttctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcctgaaggaagagtcatagacctaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagttttgaagatggttgaaccatggctaaagaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaatatcgtctcttcagtcaacatggtatccagattgctactgaacagattcacaatgacacacaggagacccaccatagagaaagatgtggatctaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccattcggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggaattcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggaaaggttaaaaagaatggccatcagcggggatgattgcgttgtgaaaccaatcgacgacagattcgccaatgccctgcttgccctgaacgatatgggaaaggttagaaaggacatacctcaatggcagccatcaaagggatggcatgattggcaacaggtccccttctgctcccaccactttcatgaattgatcatgaaagatggaagaaagttggtagttccctgcagaccccaggacgaactaataggaagagcgagaatctcccaaggagcaggatggagccttagagaaactgcatgtctagggaaagcctacgctcaaatgtgggctctcatgtattttcacagaagagatcttagactagcatccaacgccatatgttcagcagtaccagtccactgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 1508 - DNA, 10173 bp, Dengue virus; identical to SEQ ID NO: 1507

SEQ ID NO: 1509 - DNA, 10173 bp, Dengue virus; identical to SEQ ID NO: 1507

SEQ ID NO: 1510 - DNA, 7773 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactcccccaaaagattggcgacagccattgcaggcgcttgggagaatggagtgtgcggaattaggtcaacaaccagaatggagaacctcttgtggaagcaaatagccaatgaactgaactacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacacacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgaaatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccgcctggaacagctgatgcctttcctcagagcaacgctccaattcaagatgaagaaagggacataccagaacgctcatggaattcaggcaatgaatggataaccgacttcgctgggaaaacggtgtggtttgtccccagcatcaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggagaacgtaataatcaaatcttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgctcataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagtcatagacttgggctgtggaagaggaggctggtcctattactgtgccggactgaaaaaactctcagaagtgtga

SEQ ID NO: 1511 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggtgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaattacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgattttaccagtgtgccagtcttcgagcatgaggaaatcagactggcttccaatgacagtggcagctatgggagttccacctctaccactttttatttttagcttgaaagacacactcaaaagaagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttagaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagctactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1512 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaagttggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaagatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttgggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1513 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgtttatagctttcctcagatttctagccattccaccaacagcaggagtcttggctagatggggaaccttcaagaagtcgggggccattaaggtcctgaaaagcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgctagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacagtggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatggcacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagttagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagatggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggagttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacggcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaaacagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccattttacggacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaagggtggccaatatcaaaaatggacttgggagtacccctgctggcattgggatgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctgattttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacaccatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatatacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttatatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgaattcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1514 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaaaaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1515 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaacttaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttactgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccaccagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1516 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcattcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggagagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacctccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgtgcgaaatttcaatgtctagaaccaatagagggaaaagtggtgcaatatgagaaccttaaatacactgtcatcatcacagtgcacacaggggaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagatccaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacagtactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacctccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcttcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaagatggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcaaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacctggcaaaagcaaacccaaagatctggcgttctatgggacgtacccagccccccagaaacacagaaagcagaactggaagagggggtctataggatcaaacaacaaggaatttttgggaaaacccaagtgggggttggggtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacaaagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggttcgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttaacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacctggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttttgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacactaggacacccaggcccatgccagggacaagaaaggttatggagattacagcggaatggctttggagaaccctgggaaggaacaaaaaacccagactgtgcacaagagaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaagcagacctcgagaaccctcatctgctagagaagaaaatcacacaatggttggaaaccaaaggagtggagagattaaaaagaatggccatcagcggggatgattgcgtggtgaaaccgattgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttctagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1517 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggccagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggagagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggcttgtttggaaaaggaagcttggtgacatgtgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagaaggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttaggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggtacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccgtactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagattggaaccaaactgggccagcgtgaaaaaagatctgatttcatacggaggaggatggagattgaacgcacaatggcaaaagggagaagaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacaaagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacatacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttaacagatggacccgagcgagtgatcctggctggaccaatgccagtcaccgcagcgagcgctgcgcaaaggagagggagagttggcaggaacccacaaaaggaaaatgaccagtacatatttacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttggcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaaacaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttccatcatgaaatcagttggaacaggaaggagaggaacggggtcacaaggcgaaaccttaggagaaaagtggaaaaagaaattaaatcagttatcccggaaagagtttgagctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagtccaacagtggaagaaagcagaactataagagttttgaagatggttgagccatggctaagaaacaaccagttttgcattaaagtattaaacccttacatgccaactgtgattgagcacctagaaaaactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacactaggacacccaggcccatgccagggacaagaaaggttatggagattacagcggaatggctttggagaaccctgggaaggaacaaaaaacccagactgtgcacaagagaagagttcacaaaaaaggtcagaaccaacgcggctatgggagcagttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgatctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgactggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatctaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1518 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgttgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtagggaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaagggaagcttggtgacatgcgcgaaatttcaatgtctagaaccaatagagggaaaagtggtgcaatatgagaaccttaaatacactgttatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacgggcttggatttcaatgaaatgattttattgacaatgaaaaacaaagcctggatggtacataggcaatggttctttgacctacccctaccatggacatcaggagctataacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatctttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggagagcaacatagtgattggaattggagacaaagccttgaaaattaactggtacaagaagggaagctcgattgggaagatgttcgaggccactgctagaggtgcaaggcgcatggccatcttgggagacacagcctgggactttggttcagtgggtggtgttctaaattcattagggaaaatggtgcaccaaatattcggaagtgcttatacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaactaacatatggctgaaactccgagaggtgtatacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcaggaaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaattcgggaaaaaacacatgattgcaggggttctcttcacgtttgtgctcctcctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggatcaccgactttgttgggaagacggtgtggtttgtccctagcatcaaagccggaaatgacatagcaaactgcttgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatatggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagctacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagctaggtaccttgagttcgaagcactcggatttttaaatgaagaccactggttctcgcgtgaaaactcttacagtggagtagaaggagaaggactgcataagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaggtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggaatctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1519 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgttgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtagggaacagagattttgtggaaggtctgtcaggagctacgtgggttgatgtggtgctcgagcacggtgggtgtgtgaccaccatggctaagagcaagcctacgttggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacgggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgctagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgccttaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctcctcctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagccgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgatccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttactaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgttactgaacagatttacgatgacacacaggagacccaccatagagaaagatgtggatttgggagcaggaactcgacatgtcaatgcggaaccagaaacacccaacatggacgtcattggagaaaggataaaaaggatcaaggaggagcatagttcaacatggcactatgatgatgaaaatccttataaaacgtgggcttaccatggatcctatgaagtcaaagccacaggctcagcctcctctatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaggtggtcaaagttcaacgaccaactccaaaaggcacggtaatggatatcatatctaggaaagaccaaagaggcagtggacaggtggggacttatggtctgaacacattcaccaacatggaagcccagttagtcagacagatggaaggagaaggtgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1520 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggtcaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacggtgcacacaggagaccaacaccaggtgggaaatgatacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagaaggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaatcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctactgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagactacgggtttggagtcttcacaaccaacatatggctgaaactccgagaggtgtacacccaatcatgtgatcataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacatactctttggagcaatggtgtactagagagtgacatgatcatcccaaagagtctagctggtcctatttcacaacacaaccacaggcccgggtactacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggctctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaatttttacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaacctaactataatggatcttcatcccgggtcaggaaagacgcggaaatatcttccagccatcgtcagagaagcaatcaagagacgcttaagaactctaattttggcaccaacaagagtggttgcagctgagatggaagaagcactgaaaggacttccaataaggtaccaaacaactgcaacaaaatctgaacacacaggaagggagattgttgatctaatgtgccacgcaacattcacaatgcgcttattatcaccagtcagggttccaaattacaatttggtagtaatggatgaggcccatttcacagacccagccagtatagcggctagagggtacatatcaactcgtgtaggaatgggagaggcagctgcaattttcatgacagcaacaccccctggaactgctgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatgggaaaaaggtcatccaacttagtaggaagacctttgatacagaatatcaaaagaccagactgaatgattgggacttcgtggtgacaacagacatttcagaaatgggagctaactttagagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgagccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgccctcgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaaccacaaagagagatttaggaatgtctaaagaaccaggtgttgtttccccaaccagctatttagatgtagacttgcacccagcatcagcctggacattgtacgccgtggccacaacagtaataacaccaatgttgagacataccatagagaattccacagcaaatgtctccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattgaacccttacatgccaactgtgattgagcacctagaaagactacaaagaaaatatggaggaatgcttgtgagaaacccactctcacgaaactccacgcatgaaatgtactggatatccaatggtaccggcaacatcgtctcatcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggactcccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagactaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1521 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagttgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgttggacatagagcttcagaagaccgaggccacccaactggcgaccctaaggaagttatgcattgagggaaaaattaccaacataacaactgactcaaggtgtcctacccagggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacttttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggagagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcgtgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacatacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagttagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaatgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagcagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgaggtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgtcgtttctccaaccagctatttagatgtagacttgcacccagcatcagcctggacattgtacgctgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgatctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagttttaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatattccatacctagggaagagagaagatcaatggtgcggatcactcattggtctcacctccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1522 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagaaccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacattcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtaataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccgctgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtgcctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaagtgagaagccttataggcgatgaagaatttctggactacatgccttcgatgaagagattcaggaaggaggaggagtcagagggagccatttggtaa

SEQ ID NO: 1523 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagaaccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataagcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaggaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggctggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagacctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcattcaacttagtagaaagacttttgatacagaataccaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgcttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcatcaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagaaaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaacagcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1524 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaagactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaagaaacacatgattgcaggggttctcttcacgtttgtgctccttctctcagggcaaataacatggagagatatggcacacacactcataatgattggatccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatatcccacttcaatggatcgcgtcggctatagttctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagataaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagctaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattgaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttatcatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcactaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctatgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcaatgaagaatttctggactacatgccttcgatgaagagattcaggaaggaggaggagtcagagggagccatttggtaa

SEQ ID NO: 1525 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaaatggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgtcctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggaggttgagcgcacaatggcaaaagggagaggaggtgcaggttattgccgtagagcctgggaagaacccaaaaaacttccaaaccatgccgggcatttttcagacaacaacgggggaaataggagcaattgcactagatttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatctacatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcagctaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgagggattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacaggcaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1526 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccctggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatacagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcacacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagaggatacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgctattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatctcggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtattggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggtgatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1527 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtggttgtccttggatcgcaagagggagcaatgcacacagcactgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcaatgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaagactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacagcgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaatatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1528 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttacaaatgccccctcgttgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccaaggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaagaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaatcaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccttgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactccccgaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaacgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaactgacatctagagaaaatttgttgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcactctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagttatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaattgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtggtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaataatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaattgagacctaggtggcttgatgcccgcacttattcagatcccttagcacttaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttgttaacaggtggagcaatgcttttcctgatatcaggtaaagggattggaaagacttcaataggactcatttgtgttattgtttccagtggtatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactagcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggttgtggaagaggaggctggtcatattattgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtgccagtccattggatccctacaagcagaacgacatggtctattcacgctcaccatcagtggatgaccacagaagacatgctaactgtctggaacagggtgtggatagaggacaatccatggatggaagacaaaactccagttacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1529 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttatagatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttacactactaatgctggtcactccatccatgacaatgagatgcgtgggagtaggaaatagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctactcagggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgttatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacttttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggaaacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcctacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcgtgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctccttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctctttgaagaggtgatgagaggaaaatttgggaaaaaacacatgattgcaggggttctcttcacgtttgtgctccttctctcagggcaaataacatggagagatatggcacatacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggattaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcccgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatttaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaaaggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagcagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgtcgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcagaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggatgaactgataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatattccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1530 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcgaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtaagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgctattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1531 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttgctttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataagcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccatcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggccttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttatagtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1532 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggtcatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgccctacccagggggaagcgattctacctgaggagcaggaccagaactacgtgtgtaagcatacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcatacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactggagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcatgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcagcaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtagcagctatgggagttccacccttaccactttttatcttcagcttgaaggacacaccaaaaaggaggagctggccactgaatgagggggtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcgtctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagtgtgaaaaaagatctgatttcatacggaggaggatggagattgagcgcacaatggcaaaaaggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggttacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagatcgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccccggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagacagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgttgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggatctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttgtcccggaaagagtttgacctttacaagaaatctggaattactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgtgcaggactgaaaaaagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctactaaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaaccgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1533 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagccttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgccctacccagggggaagcgattctacctgaggagcaggaccagaactacgtgtgtaagcatacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcatgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtagcagctatgggagttccacccttaccactttttatcttcagcttgaaggacacaccaaaaaggaggagctggccactgaatgagggggtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcgtctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagtgtgaaaaaagatctgatttcatacggaggaggatggagattgagcgcacaatggcaaaaaggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccccggaactgctgaagcctttccccagagcaacgctccaattcaagatgaagaaagggatattccggaacgctcatggaattcaggcaatgaatggattaccgactttgttggaaagacggtgtggtttgtacccagcatcaaagccggaaatgacatagcaaactgcctgcggaaaaatgggaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccggtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagacagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggatctaggcgtaccgctactggcactaggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttgtcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgtgcaggactgaaaaaagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctgctgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctctatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaacacatttaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgtgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaaccgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1534 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtggatgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccatcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgttcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttacagtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1535 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctaaacggccagggaccaatgaaattggtaatggcgttcatagctttcctcagatttctagccattccaccaacagcaggagtcttggctagatggggaaccttcaagaagtcgggggccattaaggtcctgaaaggcttcaagagggagatctcaaacatgctgagcataatcaacaaacggaaaaagacatcgctctgtctcatgatgatattgccagcaacacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaaaaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggaaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgaaataacacctcaggcatcaaccactgaagccatcttgcctgaatatggaactcttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcagggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatgaacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagccgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggaaaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaagaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgttagagagtgacatgatcattccaaagagtctagctggtcctatctcgcaacacaactacaggcctgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggccatggcaacaacgttacaactgccagaagacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagccatgggagttccacctctaccactttttatttttagcttaaaagacacactcaaaaggagaagctggcctctgaatgaaggggtaatggctgttgggcttgtgagcattctggctagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatattccatacccgcaacattgttggtctggcatacttggcaaaagcaaacccaaagatccggcgttctatgggatgtacctagccctccagagacacagaaagcagaactggaagaaggggtctataggatcaaacagcaaggaatttttggaaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaagtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaactataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacggaaaaaaggtcattcagctcagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggacgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgccctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctcataccagaaccagaaaagcagagaaccccccaagacaaccaactcgcatatgtagtgataggcatacttacattggcagcaacaatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaagggtggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctgttatgaaatcagttggaacagggaaaagaggaacaggctcacagggcgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaagcttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtaattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaagtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatctccaagatacccggaggagctatgtatgctgacgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaatcctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgtagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggtgccatttggtaa

SEQ ID NO: 1536 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttattttcatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaataagcccacgttggatatagagcttcagaagaccgaggccacccaactggcgaccctaaggaagctatgcattgaggggaaaatcaccaacgtaacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcgggacacttaaaatgtagacttaagatggacaaattagaactcaaggggatgagctatgcaatgtgcacgaatacctttgtgttgaagaaagaagtctcagaaacgcagcatgggacaatactcatcaaggtcgagtataaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcatgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaagaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagaacaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggtttggagtcttcacaaccaacatatggctgaaactccgagaagtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttatgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatctattgttaggagttgggctggctatggcaacaacgttacaactgccagaggacattgaacaaatggcaaatggaatcgctctggggctcatggctcttaaactgataacacaatttgaaacataccaattatggacagcattaatctccttgacatgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccgctgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaggatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcactttccaaactacaacaggagaaataggagcaattgcactggatttcaagcctggaacttcaggatctcctatcataaacagagagggaaaggtagtgggtctgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagtcagggttccaaactataacttgataataatggatgaagcccacttcacagacccagccagtatagctgctagagggtacatatcaactcgtgttggaatgggagaagcagccgcaattttcatgacagcaacgccccctggaacagccgatgcctttcctcagagcaacgctccaattcaagatgaagaaagggacataccagaacgctcatggaattcaggcaatgaatggataaccgacttcgctgggaaaacggtgtggtttgtccccagcatcaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctagggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacccgggaagttttggaacaccacgatagctgtttccatggcgaacatttttagagggagctatttagcaggagctgggctcgctttctctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaggccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacggaagtgcgaggatacacaaaaggcggtccaggacacgaagaaccagtacctatgtccacatatggatggaacatagtcaagttaatgagtggaaaggacgtgttttatcttccacctgaaaagtgtgacaccctgttgtgcgacattggagaatcttcaccaagcccaacagtggaagaaagcagaactataagagttttgaagatggttgaaccatggctaaagaacaaccaattttgtattaaagtattgaacccttatatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggtcagcagagagtctttaaagagaaagtggacaccaggacacccaggtccatgccaggaacaagaagggttatggggattacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagtccaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctactcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1537 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaatggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaatcaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaatggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggaacttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgactacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaattaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagcgcctcaagagcatggaatgtgtgggaggtggaagattacgggttcggagtcttcacaaccaacatatggctgaaactccgagaggtgtatacccaacaatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagtcgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccggaggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttagtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtacaggttattgccgtagagcctgggaagaacccaaagaactttcaaactatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagccgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgattgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagctatgcttttcttaatatcaggcaaagggattggaaagacttcaataggactcatttgtgtaatcgcttccagtggcatgttgtggatggccgaaatcccactccaatggatcgcgtcggccatagtcctggagttttttatgatggtgctgctcataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggttctgatgggtttggacaaaggatggccaatatcaaaaatggacttaggagtacccctgctggcattaggttgctattcacaagtgaacccactgactctaacagcggcagtactcttgctgatcacacattatgctattataggtccaggactgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccatcgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaagcccaggttgtgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaagcagttagcgaacgctatatttaaactcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1538 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggctttaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggcccttaggcacccagggttcaccatactagccctatttcttgcccattacataggcacttccttgacccagaaggtggttatttttatactgctaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaactatgtgaccataggttaatgtcggcagccgtcaaggatgaaagggccgtacatgccgacatgggctattggatagaaagtcaaaagaatggaagttggaagctagaaaaagcatccctcatagaggtgaaaacctgcacatggccaaaatcacataccctttggagtaatggtgtgttagagagtgacatgatcattccaaaaagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagaaaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctctcaaactgataacacaatttgaaacataccaactatggacagcattaatctccttaacgtgttcaaatacaatttttacgttgactgttgcctggagaacagccaccctgattttggctggagtttcacttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtgtcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcccggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcactgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccttagcactcaaggaattcaaggactttgcggctggcaggaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacactggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattccacagcaaatgtgtccttggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaggtggatagaacagaagccaaagaagggttgaaaagaggagaaataacacatcatgccgtgtccagaggtagtgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgcgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactacgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccataagtggggatgactgcgtggtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagagtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggttagaagccttataggcaatgaagagtttctggactacatgccttcaatgaagagatttaggaaggaggaggagtcggagggagccatttggtaa

SEQ ID NO: 1539 - DNA, 10173 bp, Dengue virus; identical to SEQ ID NO: 1538

SEQ ID NO: 1540 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacggccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggggttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaatacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcactgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcaggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcgacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtgtcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaagggatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtaattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacggaaaaaaggtcattcaacttagtaggaagacttttgacacagaatatcagaaaactaaactgaatgattgggactttgtggtgacaactgacatttcagaaatgggagccaatttcaaagcagatagagtgatcgacccaagaagatgtctcaaaccagtgattctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaagatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgtttccagcggtatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttagaaactacaaagagagatttaggaatgtctaaggaaccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggacgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggctcaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtacgctgatgacacagctggttgggacacaagaataacagaagatgacctgcacaacgaggaaaagatcacacagcaaatggaccctgagcacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtggtaaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagtcttagagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1541 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatatcaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgatgtggtgctcgagcacggggggtgtgtgaccaccatggctaagaacaaacccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacttacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgctgaagaaagaagtttcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaaaagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttgatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccgctgaatgaaggggtgatggctgttgggcttgtgagcattctggccagttctctccttagaaatgacgtacccatggctggaccattagtagccgggggcttgctgatagcgtgttacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaagccaagtaggggttggagtacagaaagaaggagtctttcacaccatgtggcacgttacaagaggggcagtattgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaacggtggctacgtcagcggaatagcgcaaacgaatgcagaaccagatggaccgacaccagaattggaagaagaaatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggtaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaaggaattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaagaacagctgctggaataatgaagaatccaacggtggatgggataatgacaatagacctagatcctgtaatatatgattcaaaatttgaaaagcaactgggacaagttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctatcatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactctacgcacgaaatgtactggatatctaatggcacaggtaacattgtcgcttcagtcaacatggtatctagactgctactgaacaggttcacgatgacatacagaagacccaccattgagaaagatgtggatttaggagcaggaactcgacatgttaatgcggaaccagaaacacccaacatggatgtcattggggaaagaatagaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccagaatacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctatatactaagggacatttccaaaatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggagccatttggtaa

SEQ ID NO: 1542 - DNA, 10173 bp, Dengue virus
atgaacaaccaacggaagaagacgggaaaaccgtctatcaatatgctgaaacgcgtgagaaaccgtgtgtcaactggctcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggctacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatcttggagctgtagtgcaagctgacatggggtgtgttataaactggaaaggtaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaagtactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgcgaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcccatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcctcacgtttgtactccttctctcagggcaaataacatggagagatatggcgcacacactaataatgattgggtccaacgcatctgacaggatgggaatgggcgttacctacctagctttaattgcaacatttaagatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctttaccactttttatctttaacttaaaagacacactcagaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactagatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctatcgttagagaggcaatcaagagacgtttgagaactctaattctggcaccgacaagggtggttgcagctgagatggaagaagcactgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggcaaggcctacaggcatgcggtggaggaactaccagagacaatggaaacactcctactcttgggactcatgatcttgttgacaggtggagcaatgcttttcttaatatcaggtaaagggcttggaaagacttcaataggactcatttgtgtaattgcttccagcggcatgttgtggatggccgaaatcccactccaatggatcgcgtcggccatagtcctggagttttttatgatggtgttgctgataccagaaccagaaaagcagagaaccccccaagacaaccaactcgcatatgtcgtgataggcatacttacattggcagcaataatagcagccaatgaaatgggattgttggaaactacaaagagagatttaggaatgtctaaagaaccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcatccccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagagagactacaaaggaaacatggaggaatgcttgtgagaaatccactttcacgaaactccacgcacgaaatgtactggatatctaatggcacaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgatacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcagggagcgggatggagtcttagagaaaccgcatgtctgggaaaagcctacgctcaaatgtggagtctcatgtattttcacagaagagacctcagattagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1543 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagttgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagctatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattccattctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctatggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtctttacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctacaggatcaaacagcaaggaatctttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagcatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaagaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagctaatgaaatgggattgctggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatacgattcaaaatttgaaaagcaactgggacaggttatgctcctggttttgtgtgcagttcaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttctatcatgaaatcagttggaacagggaaaagaggaacaggctcacagggtgaaactttaggagaaaaatggaaaaagaggttaaatcaattatcccggaaagagtttgacctttacaagaaatctggaatcactgaagtggatagaacagaagccaaagaagggttgaaaaggggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtagaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccattcggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaagttgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatctccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccctacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1544 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggttctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagttgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgttcttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagatccctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaactatgtgaccataggctaatgtcggcagccgttaaggatgaaagggccgtacatgctgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttattcacgtttgtactccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcgaatacaattttcacgttgactgttgcctggagaacagccaccctgattttggccggagtttcacttttaccagtgtgccagtcttcgagcatgaggaaaacagactggcttccaatgacagtggcagctatgggagttccacctctaccactttttattttttgcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttctgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcagaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcagacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggtcgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcctgcgaaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcatgccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagctacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagtgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaaatgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgtacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacggaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1545 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccaatcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1546 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggcccttaggcacccagggttcaccatactagccctatttcttgcccattacataggcacttccttgacccagaaggtggttatttttatactgctaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcaataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattgacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaatacaccggagtgtccaaatacctcaagagcatggaatgtgtgggaggtggaagattacgggttcggagtcttcacaaccaacatatggctgaaactccgagaggtgtatacccaactatgtgaccataggctaatgtcggcagccgtcaaggatgaaagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggctggagtttcacttttaccagtgtgtcagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcccggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataactgacttcgctgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccttagcactcaaggaattcaaggactttgcggctggcagaaagtcaatagcccttgatcttgtgacagaaataggaagagtgcctacacacctagctcatagaacgagaaacgccctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttgagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattacgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtactgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagggtgtggatcgaggacaacccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1547 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttccttagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacaccccaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaggggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaattgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacatactctttggagtaatggtgtgttagagagtgacatgatcattccaaagagtctagctggccctatctcgcaacacaactacaggcccgggtaccacacccagacggcgggaccctggcatttaggaaaattagagctggacttcaactattgtgaaggaacaacagtagtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgtgggggttttcttcacgtttgtactccttctctcagggcaaataacatggagagatatggcgcacacactaataatgatcgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacctcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggaggttgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatttaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacaagaaacgctctggacaatctggtgatgctgcatacgtcagaacatggcggtaaggcctacaggcatgcggtggaggaactaccagagacaatggaaactctcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaagatggatttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacataggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccgtggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1548 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtgttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggtttaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagacagaggccacccaattggcgaccctaaggaagctatgcattgaggggaaaattaccaacataacaactgactcaagatgtcctacccaaggggaagcggttttgcctgaggagcaggaccagagctacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcacacacactaataatgattgggtccagcgcatctgacaggatgggaatgggcgttacctacctagctttaattgcaacatttaaaatccagccattcttggctctgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtagttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactaaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaacgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtaaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaaccttaggagaaaaatggaaaaagaaattgaatcaattatcccggaaagagtttgacctttacaagaaatctggaatcactgaagtggatagaacagaagccaaagaagggttgaaaagaggagaaataacacatcatgccgtgtccagaggtagcgcgaaacttcaatggtttgtggagagaaacatggtcattcccgaaggaagagtcatagacttgggctgtggaagaggaggctggtcatattactgtgcaggactaaaaaaagtcacagaagtgcgaggatacacaaaaggcggtccaggacacgaagaaccagtacccatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacacacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgtcaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggttaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaatcacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgctcactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1549 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaactggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaatgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgcccactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccacaaagtagcatcagaagggatcaaatatacagatagaaaatggtgctttgatggacaacgtaacaatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtaacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatactactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacgggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1550 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgatcgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggtcttgcctgaggagcaggaccagaactacgtgtgtaagcatacatacgtagacagaggctgggggaacgggtgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtcctcggatcgcaagagggagcaatgcataccgcattgacaggagccacagaaatccaaaactcaggaggcacaagcattttttcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatgggccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatgactcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggtaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatgcagatagaaaatggtgctttgatggacaacgtaataatcaaattttagaggagaacatggatgtggaaatctggacaaaggaaggagaaaagaaaaaattgagacctagatggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttcttcaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggacttttggaaacttgtggacagagaacgtgaactccacaaattgggcaagtgtggaagctgtgtatacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatagtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtgccagtccactgggtccccacaagtagaacgacatggtctattcatgctcaccatcagtggatgaccacagaagacatgcttactgtctggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggaatcggagggagccatttggtaa

SEQ ID NO: 1551 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaacatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatactgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctctcaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaagcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacgaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaaggcataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1552 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgtttatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgctaaatttcaatgcctggaaccaatagagggaaaagtggtgcaatatgagaacctcaaatacaccgtcatcatcacagtgcacacaggagaccaacaccaggtgggaaatgaaacacagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgtcataaactggaaaggcaaagaactcaaatgtggaagtggaatcttcgtcaccaacgaggtccatacctggacagagcaatacaaattccaagcagactccccaaaaagattggcgacagccatcgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagttagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcttaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttggacttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaaaacagcattactaatagtatcaggaatctttccatactccatacccgcaacattgttggtctggcatacttggcataagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaaccctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccggtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaatcttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtaaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagttcggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggtagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtagagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgagttgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagggcaacctgggcccagaacatacccacagcaattcaacaggtgagaagccttataggcaatgaagagtttctggactacatgccctcaatgaagagatttaggaaggaggaggagtcggagggagccatttggtaa

SEQ ID NO: 1553 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgtttatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccactacataggcacttccttgacccagaaggtggttatttttatactactaatgctggtcaccccatccatgacaatgagatgtgtgggagtaggaaacagagattttgtggaaggcctatcaggagccacgtggattgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcattatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacatgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggccgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgccagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgatatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggacttatttgtgtaattgcttccagcggcatgttgtggatggccgaaattccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagccatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtctttaaagagaaagtggacaccaggacacccaagtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1554 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgtttatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttattttcatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccattttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgatcttggccggagtttcgcttttaccagtgtgccagtcttcgagcatgaggaaaacagactggcttccaatgacagtggcagctatgggagttccacctctaccacttttcatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagtggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatactactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcatgaaatgtattggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaattaataggaagagcaagaatctctcaaggagcgggatggagccttagagaaaccgcatgtctggggaaagcctacgctcaaatgtggaatctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1555 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagctacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgctttgaaaatcaactggtacaagaagggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcatcgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtttgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccgtcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgatagcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattgatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactctttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaagaaagatctgatttcatacggaggaggatggagattgagcgcacaatggcaaaagggggaggaggtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggattatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtctccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccggagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattaatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1556 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctttgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaattctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaattgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgtcagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaatcagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcagccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatttagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1557 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtttagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgtcagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatccttacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggaaagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacatacagaagacccaccattgagaaagatgtggttttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatttagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1558 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaatggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctaaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggttattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagccacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagactttcgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccggagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgaatatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggtatgcggtggaggaactaccagagacaatggaaacactcctactcctgggactcatgatcttgttgacaggtggagcaatgctcttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtgtctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacatgggcttaccacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggatagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1559 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaagtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagagacatgggccctcaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctgcaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagaacctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtatcaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggagtaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggcttacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgctggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcggcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1560 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaataggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtatgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtacaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccgattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcacaaagaagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatactcacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaataaaaaacccaggttgtgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggcctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1561 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttctcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggattccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatggaaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctatgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacatcagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatttgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1562 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgtctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttctttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggataaattagaactcaaggggatgagctatgcaatgtgcacgaatacctttgtgttgaagaaagaagtctcagaaacacagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatgtaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaacggaagttggaagctagaaaaagcatccctcatagaggtaaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactactgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaattgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatttttatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtattgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaactatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccggtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcatgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaggtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaatatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1563 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcaggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactattaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacagcgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcactaacgaggttcatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggtcttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctttaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacgttgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaaaactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcccacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttactgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagagataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1564 - DNA, 10173 bp, Dengue virus
atgaacaaccaacggaagaagacgggaaaaccgtctatcaatatgctgaaacgcgcgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctactcaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1565 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagattcctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggagagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggaactatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1566 - DNA, 10173 bp, Dengue virus; identical to SEQ ID NO: 1565

SEQ ID NO: 1567 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagattcctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggagagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttgattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1568 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagattcctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggagagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1569 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagttgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattccattctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtctttacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctacaggatcaaacagcaaggaatctttgggaaaacccaagtaggggttggagtacagaaagaaggagtctttcacaccatgtggcacgttacaagaggggcagtgttgacatgtaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagctaatgaaatgggattgctggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatacgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctatcatgaaatcagttggaacagggaaaagaggaacaggctcacagggtgaaactttaggagaaaaatggaaaaagaggttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtagaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaacccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccattcggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaagttgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttaggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccctacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1570 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaagcggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttacggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaagtccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgagaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaagttaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaatacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcgacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaagggatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaacccgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggaaccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggacgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagttacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggctcaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaagaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcctatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatctccaagatacccggaggagctatgtacgctgatgacacagctggttgggacacaagaataacagaagatgacctgcacaacgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtggtgaaaccaatcgatgacaggttcgctaatgccctgctcgctctgaacgatatgggaaaggttcggaaagacattcctcaatggcagccatcaaagggatggcatgattggcaacaggttcctttctgctcccaccactttcatgaattgatcatgaaagatggaagaaagttggtggttccctgcagaccccaggacgaattaataggaagagcaagaatctctcaaggagcgggatggagtcttagagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1571 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaataagcccacgttggatatagagcttcagaagaccgaggccacccaactggcgaccctaaggaagctatgcattgaggggaaaatcaccaacgtaacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtataaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagaacaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggtttggagtcttcacaaccaacatatggctgaaactccgagaagtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacatgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcactttccaaactacaacaggagaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagtcagggttccaaactataacttgataataatggatgaagcccatttcacagacccagccagtatagctgctagagggtacatatcaactcgtgttggaatgggagaagcagccgcaattttcatgacagcaacgccccctggaacagccgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctagggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggctcgctttctctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaggccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggacgtgttttatcttccacctgaaaagtgtgacaccctgttgtgcgacattggagaatcttcaccaagcccaacagtggaagaaagcagaactataagagttttgaagatggttgaaccatggctaaagaacaaccaattttgtattaaagtattgaacccttatatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggattacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1572 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccatcaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctagaaccagtagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaatgccttgaagatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggaaaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaagtcacataccctttggagcaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgcttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcacttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaggcagaactggaagaaggggtctataggatcaaacagcaaggaatttttggaaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcagaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagctagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcactgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaatcttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcccacacacctagctcatagaacgagaaacgctctggacaatctggtgatgctgcacacgtcagaacatggcggtaaggcctacaggcacgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagacttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttgatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggagagagtttgacctttacaagaaatctggaatcactgaagtggatagaacagaagccaaagaagggttgaaaagaggagaaataacacaccatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatacggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggtcgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatattaatgcggaaccagaaacacccaacatggatgtcattggggaaagaataaaaaggatcaaggaggagcataattcaacatggcactatgatgaagaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggcccatgccaggaacaagaagggttatggggatcacagcggagtggctctggagaaccctgggaaggaacaaaaaacccaggttatgcacaagggaagagtttacaaaaaaggtcagaactaacgcagctatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggctgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacacgaataacagaagatgacctgcacaatgaggaaaagatcacacagcaaatggaccctgaacacaggcagttagcgaacgctatatttaagctcacataccaaaacaaagtggtcaaagttcaacggccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgaaaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctggggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1573 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacgtgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcttggaatgtgtgggaggtggaagattacgggttcggagtcttcacaaccaacatatggctgaaactccgagaggtgtatacccaactatgtgaccacaggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttagggaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggataacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcattacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacctgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcattggacggaagcaaaaatgctgctggacaacattaacacaccagaagggatcataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctggatcctgtaatatatgattcaaaatttgaaaagcaactgggacaggttatgctcctggttttgtgtgcagttcagcttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacggggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacctatgtccacatatgggtggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggataccagaacacccaggtccatgccaggaacaagaagggttatggggatcacagcggagtggctctggagaaccctgggaaggaataaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagtttgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagcggacaggtaggaacttatggtctgaatacattcaccaacatggaagcccagttaatcagacaaatggaaggagaaggtgtgctgttaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtactttcacagaagagacctcagactagcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1574 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggtaatggcgttcatagctttcctcagatttctagccattccaccaacagcaggagtcttggctagatggggaaccttcaagaagtcgggggccattaaggtcctgaaaggcttcaagagggagatctcaaacatgctgagcataatcaacaaacggaaaaagacatcgctctgtctcatgatgatattgccagcaacacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaaaaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgaaataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcagggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctatcgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggaaaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcctgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccaccagtgagaaagaagagaacatggtaaagtctctagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaagacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagccatgggagttccacctctaccactttttatttttagcttaaaagacacactcaaaaggagaagctggccactgaatgaaggggtgatggctgttgggcttgtgagcattctggctagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttggaaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaagtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaagatagtgggactgtatggcaatggagtggttacaaagaatggtggctacgttagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacggaaaaaaggtcattcaactcagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgccctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacataccatagagaattctacagcgaatgtgtccctggcagctatagccaaccaggcagtggtcctgatgggtttggacaaagggtggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctgttatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtaattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaagaaagtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatctccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaatcctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggtgccatttggtaa

SEQ ID NO: 1575 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctttgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttggactagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccctgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacgtggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacggagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagaaagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgacagttgcctggagaacagccaccctgattttggccggagtctcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattttggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggggtctttcacaccatgtggcacgttacaagaggggcagtgttgacacataatgggaaaagactggaaccaaactgggctagcgtgaaaagagatctgatttcatacggaggaggatggagattgagcgcacaatggcaaaagggagaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaggtagtgggactgtatggcaatggagtggtcacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaggaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcaggaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgctttttttaatatcaggtaaagggattggaaagacttcaataggactcatttgtgttattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagcccagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagaaaaagtggacaccaggacacccaggtccatgccaggaacaagaagggttatggggatcacagcggagtggctctggagaaccctgggaaggaataaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaaaatacccggaggagctatgtatgctgatgacacagctggttgggacacaagaataacagaagatgacctgcataatgaggaaaagatcacacagcaaatggaccctgaacacaggcaattagcgaacgctatatttaagctcacatatcaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctaccagagaagaaaatcacacaatggttggaaaccaaaggagtggagaggttaaaaagaatggccattagcggggatgattgcgtagtgaaaccaattgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1576 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccagtagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcctagagcaaggaaaaagaacactaacaccacaacccatggagctaaaatactcatggaaaacgtggggaaaggcaaaaatagtgacagctgaaacacaaaattcttctttcataatagatggaccaaatacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcactgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcgacaacgttacaactgccagaggacattgaacaaatggcaaatggaatcgctctggggctcatggctcttaaactgataacacaatttgaaatataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaagggatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaagatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttagaaactacaaagagagatttaggaatgtctaaggaaccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggacgggataatgacaatagacctagatcctgtaatatatgactcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaataagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggctcaggtaacattgttgcttcagtcaacatggtatctagactgctactgaacaggttcacgatgacacacagaagacccaccattgagaaagatgtggatttaggagcaggaactcgacacgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtacgctgatgacacagctggttgggacacaagaataacagaagatgacctgcacaacgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtggtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagtcttagagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1577 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaagaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagatacctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatctatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaagtactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggacgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcctcacgtttgtactccttctctcagggcaaataacatggagagatatggcgcacacactaataatgattgggtccaacgcatctgacaggatgggaatgggcgttacctacctagctttaattgcaacatttaagatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcccgggaagaacccaaagaactttcaaaccatgccaggcacttttcagactacaacaggggaaataggagcaatcgcactagatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctatcgttagagaggcaatcaagagacgtttgagaactctaattctggcaccgacaagggtggttgcagctgagatggaagaagcattgaaaggactcccaataaggtaccaaacaacagcaacgaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctgataccagaaccagaaaagcagagaaccccccaagacaaccaactcgcatatgtcgtgataggcatacttacattggcagcaataatagcagccaatgaaatgggattgttggaaactacaaagagagatttaggaatgtctaaagaaccaggtgttgtttctccaaccagctatttagatgtggacttgcacccagcatcagcctggacattgtacgctgtggctactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagagagactacaaaggaaacatggaggaatgcttgtgagaaatccactttcacgaaactccacgcacgaaatgtactggatatctaatggcacaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccagcaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcagggagcgggatggagtcttagagaaaccgcatgtctgggaaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1578 - DNA, 10173 bp, Dengue virus
atgaacaaccaacggaagaagacgggaaaaccgtctatcaatatgctgaaacgcgtgagaaaccgtgtgtcaactggctcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggctacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctacctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaagtactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcccatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcctcacgtttgtactccttctctcagggcaaataacatggagagatatggcgcacacactaataatgattgggtccaacgcatctgacaggatgggaatgggcgttacctacctagctttaattgcaacatttaagatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatctttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactagatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctatcgttagagaggcaatcaagagacgtttgagaactctaattctggcaccgacaagggtggttgcagctgagatggaagaagcactgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggcaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctgataccagaaccagaaaagcagagaaccccccaagacaaccaactcgcatatgtcgtgataggcatacttacattggcagcaataatagcagccaatgaaatgggattgttggaaactacaaagagagatttaggaatgtctaaagaaccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcatccccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagagagactacaaaggaaacatggaggaatgcttgtgagaaatccactttcacgaaactccacgcacgaaatgtactggatatctaatggcacaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcagggagcgggatggagtcttagagaaaccgcatgtctgggaaaagcctacgctcaaatgtggagtctcatgtattttcacagaagagacctcagattagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1579 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggttgtcggctgaaggagcttggaggcaagttgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggaaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtctttacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctacaggatcaaacagcaaggaatctttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgctggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctatcatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccattcggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaagttgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1580 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcattgctttcctcagatttctagccattccaccaacagcaggagtcttggctagatggggaaccttcaagaagtcgggggccatcaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggatacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtttatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgttcaccacggacaggtttggacttcaatgaaatgatcttgctaacaatgaagaacaaagcatggatggtacatagacaatggttttttgacctacctctaccatgggcatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccaccgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtggttgtgggcgatataattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctaaaactccgagaggtgtatacccaactatgtgaccataggctaatgtcagcagccgtcaaggatgagagggccgtacatgccgacatgggctattggatagaaagccaaaagaatggaagttggaagctagaaaaagcatccctcatagaggtgaaaacctgcacatggccaaaatcacataccctttggagcaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacatcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctattataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagctagtatagctgctagagggtacatatcaactcgtgttggaatgggagaagcagccgcaattttcatgacagcaacaccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatatcagaaatgggggccaatttcaaaacagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaagaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagacttaggaatgtctaaggagccaggtgttgtttctccaaccagctatttagatgtggacttgcacccagcatcagcctggacattgtacgctgtagccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttgggagaaaaatggaaaaagaagttaaatcaattatcccggagagagtttgacctttacaagaaatctggaatcactgaagtggatagaacagaagccaaagaagggttgaaaagaggagaaataacacatcatgccgtgtccagaggtagcgcaaaacttcaatggtttgtggagagaaatatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacggatacaactccatttggccagcagagagtctttaaagagaaagtggacaccaggacacccaggcccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttgggttcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagatctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttattggtctcacttccagagcaacctgggcccagaacatatccacagcaattcaacaggtgagaagccttataggcaatgaagagtttctggactacatgccttcaatgaagagatttaggaaggaggaggagtcggagggagccatttggtaa

SEQ ID NO: 1581 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccacaggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttagggaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggataacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacggaagcaaaaatgctgctggacaacattaacacaccagaagggatcataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctggatcctgtaatatatgattcaaaatttgaaaagcaactgggacaggttatgctcctggttttgtgtgcagttcagcttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacggggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacctatgtccacatatgggtggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggataccagaacacccaggtccatgccaggaacaagaagggttatggggatcacagcggagtggctctggagaaccctgggaaggaataaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagcggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtactttcacagaagagacctcagactagcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1582 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaagggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgatgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgttgaagaaagaagtttcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagtcgtcatcacagaaaactgtgggacaagaggcccatcattgagaacaacaacagtgtcagggaagttgatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgaccgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccgctgaatgaaggggtgatggctgttgggcttgtgagcattctggccagttctctccttagaaatgacgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtattgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaacggtggctacgtcagcggaatagcgcaaacgaatgcagaaccagatggaccgacaccagaattggaagaagaaatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagccatagccaaccaggcagtggttctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaagaacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactctacgcacgaaatgtactggatatctaatggcacaggtaacattgtcgcttcagtcaacatggtatctagactgctactgaacaggttcacgatgacatacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaaaatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggagccatttggtaa
